United States Patent
Xiao et al.

(10) Patent No.: US 10,561,686 B2
(45) Date of Patent: Feb. 18, 2020

(54) MODIFIED CELL EXPANSION AND USES THEREOF

(71) Applicant: Innovative Cellular Therapeutics Co., Ltd., Shanghai (CN)

(72) Inventors: Lei Xiao, Shanghai (CN); Chengfei Pu, Shanghai (CN); Zhiyuan Cao, Shanghai (CN); Zhao Wu, Shanghai (CN)

(73) Assignee: Innovative Cellular Therapeutics Co., Ltd., Shanghai (CN)

(*) Notice: Subject to any disclaimer, the term of this patent is extended or adjusted under 35 U.S.C. 154(b) by 0 days.

(21) Appl. No.: 16/146,218

(22) Filed: Sep. 28, 2018

(65) Prior Publication Data

US 2019/0216851 A1 Jul. 18, 2019

Related U.S. Application Data

(60) Provisional application No. 62/721,791, filed on Aug. 23, 2018, provisional application No. 62/678,836, filed on May 31, 2018, provisional application No. 62/659,114, filed on Apr. 17, 2018, provisional application No. 62/622,601, filed on Jan. 26, 2018, provisional application No. 62/616,609, filed on Jan. 12, 2018.

(51) Int. Cl.
*A61K 35/17* (2015.01)
*C07K 14/705* (2006.01)
*C07K 14/725* (2006.01)
*A61P 35/00* (2006.01)
*C07K 16/28* (2006.01)
*C07K 16/30* (2006.01)
*A61K 38/00* (2006.01)

(52) U.S. Cl.
CPC .............. *A61K 35/17* (2013.01); *A61P 35/00* (2018.01); *C07K 14/705* (2013.01); *C07K 14/7051* (2013.01); *C07K 14/70503* (2013.01); *C07K 16/2803* (2013.01); *C07K 16/3092* (2013.01); *A61K 38/00* (2013.01); *C07K 2317/622* (2013.01); *C07K 2319/03* (2013.01); *C07K 2319/30* (2013.01); *C07K 2319/33* (2013.01); *C07K 2319/75* (2013.01)

(58) Field of Classification Search
CPC .............................. A61K 35/17; C07K 14/705
USPC ............................................ 424/133.1, 93.21
See application file for complete search history.

(56) References Cited

U.S. PATENT DOCUMENTS

| | | | |
|---|---|---|---|
| 9,572,837 B2* | 2/2017 | Wu | A61K 35/17 |
| 9,932,405 B2* | 4/2018 | Xiao | A61K 35/17 |
| 2005/0079170 A1 | 4/2005 | Le Gall et al. | |
| 2014/0227237 A1 | 8/2014 | June et al. | |
| 2014/0271635 A1 | 9/2014 | Brogdon et al. | |
| 2015/0038684 A1 | 2/2015 | Jensen | |
| 2016/0024175 A1* | 1/2016 | Chow | C07K 14/4748 424/278.1 |
| 2016/0250258 A1 | 9/2016 | Delaney et al. | |
| 2016/0256488 A1* | 9/2016 | Wu | A61K 35/17 |
| 2017/0015746 A1 | 1/2017 | Jensen | |
| 2017/0096638 A1* | 4/2017 | Wu | A61K 35/17 |
| 2017/0136063 A1* | 5/2017 | Perez | A61K 39/0011 |
| 2017/0145108 A1 | 5/2017 | Schreiber et al. | |
| 2017/0218337 A1* | 8/2017 | Friedman | C12N 5/0636 |
| 2017/0319638 A1* | 11/2017 | Conner | A61P 35/00 |
| 2017/0335281 A1* | 11/2017 | Loew | A61K 39/0011 |
| 2017/0368098 A1 | 12/2017 | Chen et al. | |
| 2018/0028631 A1* | 2/2018 | Chen | A61K 39/0011 |
| 2018/0153977 A1* | 6/2018 | Wu | A61K 39/00111 |
| 2018/0179289 A1* | 6/2018 | Xiao | C07K 14/70503 |
| 2018/0222995 A1* | 8/2018 | Xiao | A61K 35/17 |
| 2018/0223255 A1* | 8/2018 | Wu | A61K 35/17 |
| 2018/0243340 A1* | 8/2018 | Varadarajan | A61K 35/17 |
| 2018/0346876 A1* | 12/2018 | Xiao | C12N 5/0638 |
| 2019/0000878 A1* | 1/2019 | Xiao | C07K 14/7051 |
| 2019/0314411 A1 | 10/2019 | Xiao et al. | |

FOREIGN PATENT DOCUMENTS

| | | |
|---|---|---|
| WO | WO2012079000 A1 | 6/2012 |
| WO | WO2017027291 A1 | 2/2017 |
| WO | WO2017149515 | 9/2017 |
| WO | WO2017172981 | 10/2017 |
| WO | WO2018111763 A1 | 6/2018 |

OTHER PUBLICATIONS

Qin et al (Journal of Hematology & Oncology 10:68 ((2017)).*
Qin et al. (J. Hematol. & Oncol. 10:68 (2017); DOI 10.1186/s13045-017-0437-8).*
The PCT Search Report and Written Opinion dated Jun. 17, 2019 for PCT Application No. PCT/US19/13068, 14 pages.
Lee et al., "T cells expressing CD19 chimeric antigen receptors for acute lymphoblastic leukemia in children and young adults: a phase 1 dose-escalation trial," Oct. 2014. The Lancet, 385(9967): 517-528.
Maude et al., "Chimeric antigen receptor T cells for sustained remissions in leukemia," Oct. 2014. N Engl J Med. 371(16): 1507-1517.
Milone, et al., "Chimeric receptors containing CD137 signal transduction domains mediate enhanced survival of T cells and increased antileukemic efficacy in vivo," Apr. 2009. Molecular Therapy, 17(8): 1453-1464.
Extended European Search Report dated Nov. 25, 2019 in EP Application No. 19180127.3, Xiao et al., a corresponding foreign application of U.S. Appl. No. 16/146,218, 11 pages.
You et al., "Phase 1 clinical trial demonstrated that MUC1 positive metastatic seminal vesicle cancer can be effectively eradicated y modified Anti-MUC1 chimeric antigen receptor transduced T cells", Apr. 2016, Science China: Life Sciences, 59(4): 386-397.
Partial European Search Report dated Nov. 4, 2019 in EP Application No. 19180127.3, Xiao et al., a corresponding foreign application of U.S. Appl. No. 16/146,218, 18 pages.

* cited by examiner

Primary Examiner — Lynn A Bristol
(74) Attorney, Agent, or Firm — Lee & Hayes, P.C.

(57) ABSTRACT

The present disclosure relates to compositions and methods for enhancing T cell response and/or CAR cell expansion in vivo and/or in vitro. For example, a cell may comprise a first chimeric antigen receptor (CAR) and a second CAR, wherein a binding domain of the first CAR binds a first antigen, and a binding domain of the second CAR binds a second antigen. The first antigen is different from the second antigen. In embodiments, the first CAR may recognize a surface molecule of a blood cell.

9 Claims, 20 Drawing Sheets

Specification includes a Sequence Listing.

MODIFIED CELL EXPANSION AND USES THEREOF

CROSS REFERENCE TO RELATED PATENT APPLICATIONS

This application claims the benefit of U.S. Provisional Application 62/721,791, filed on Aug. 23, 2018; U.S. Provisional Application 62/678,836, filed on May 31, 2018; U.S. Provisional Application No. 62/659,114, filed on Apr. 17, 2018; U.S. Provisional 62/622,601, filed on Jan. 26, 2018; and U.S. Provisional Application No. 62/616,609, filed on Jan. 12, 2018; which are hereby incorporated by reference in their entirety.

SEQUENCE LISTING INFORMATION

A computer readable textfile, entitled "Sequence Listing.txt," created on or about Sep. 27, 2018 with a file size of about 917 KB, contains the sequence listing for this application and is hereby incorporated by reference in its entirety.

TECHNICAL FIELD

The present disclosure relates to compositions and methods for expanding modified cell including modified T cells, and uses thereof in the treatment of diseases, including cancer.

BACKGROUND

Chimeric Antigen Receptor (CAR) T cell therapy has achieved good clinical efficacy in cancer such as B-ALL/CLL/lymphoma. However, progress is relatively slow for treatment of solid tumors. For CAR T cell therapy to be effective, long-term maintenance of CAR T cells in a patient is important for the prognosis of the patient in the treatment of tumors. For example, if the long-term presence of CAR T cells can be maintained, this technology may effectively reduce tumor recurrence.

Cancer is known as malignant tumors involving abnormal cell growth with the potential to invade or spread to other parts of the body. In humans, there are more than one hundred types of cancer. One example is breast cancer occurring in the epithelial tissue of the breast. Since breast cancer cells lose the characteristics of normal cells, the connection between breast cancer cells is lost. Once cancer cells are exfoliated, they spread over the entire body via the blood and/or lymph systems and therefore become life-threatening. Currently, breast cancer has become one of the common threats to women's physical and mental health. Although immunotherapy (e.g., CAR T) has been proven to be effective for treating cancer, there is still a need to improve immunotherapy so that it is more effective for certain cancer such as solid tumors.

SUMMARY

Since a patient can survive the depletion of B cells, B cells of the patient may be used to expand the CAR T cells in the patient using the first antigen binding domain. Accordingly, more CAR T cells may be timely expanded in the patient, increasing the potency of CAR T cells. The timely expanded CAR T cells in the patient may increase the chances for the CAR T cells to come in contact with tumor cells, especially solid tumor cells having the antigen that the second CAR binds.

The present disclosure describes genetically modified cells, such as T cells, that include two different antigen binding domains: a first antigen binding domain for expanding the modified cell, and a second antigen binding domain for killing a target cell, such as a tumor cell. For example, the first antigen binding domain binds a surface marker, such as a surface antigen, of B cells, and the second antigen binding domain binds the target antigen of tumor cells. The two antigen binding domains can be on the same CAR molecule, on different CAR molecules, or on a CAR and a T cell receptor (TCR). In embodiments, the first binding domain binds a cell surface molecule of a white cell, while the second binding domain binds an antigen that is different from the cell surface molecule of a white cell and is a tumor antigen.

The two antigen binding domains can be encoded by a single nucleic acid or more than one nucleic acids. In embodiments, the cell includes a modified T cell, for example a CAR T cell. In embodiments, the target cell includes a cell of a solid tumor.

The present disclosure also describes one or more nucleic acids encoding a first CAR and a second CAR or TCR. The first CAR includes the first antigen binding domain and the second CAR or TCR includes the second antigen binding domain. In embodiments, the first CAR and the second CAR or TCR are expressed as separate polypeptides and encoded by at least two separate nucleic acids. In embodiments, a single CAR contains at least two antigen binding domains and is encoded by a single nucleic acid. Embodiments described herein relate to vectors comprising a nucleic acid described herein and to cells comprising a nucleic acid described herein.

This Summary is not intended to identify key features or essential features of the claimed subject matter, nor is it intended to be used to limit the scope of the claimed subject matter.

BRIEF DESCRIPTION OF THE DRAWINGS

The Detailed Description is described with reference to the accompanying figures. The use of the same reference numbers in different figures indicates similar or identical items.

DETAILED DESCRIPTION

Figure 1:
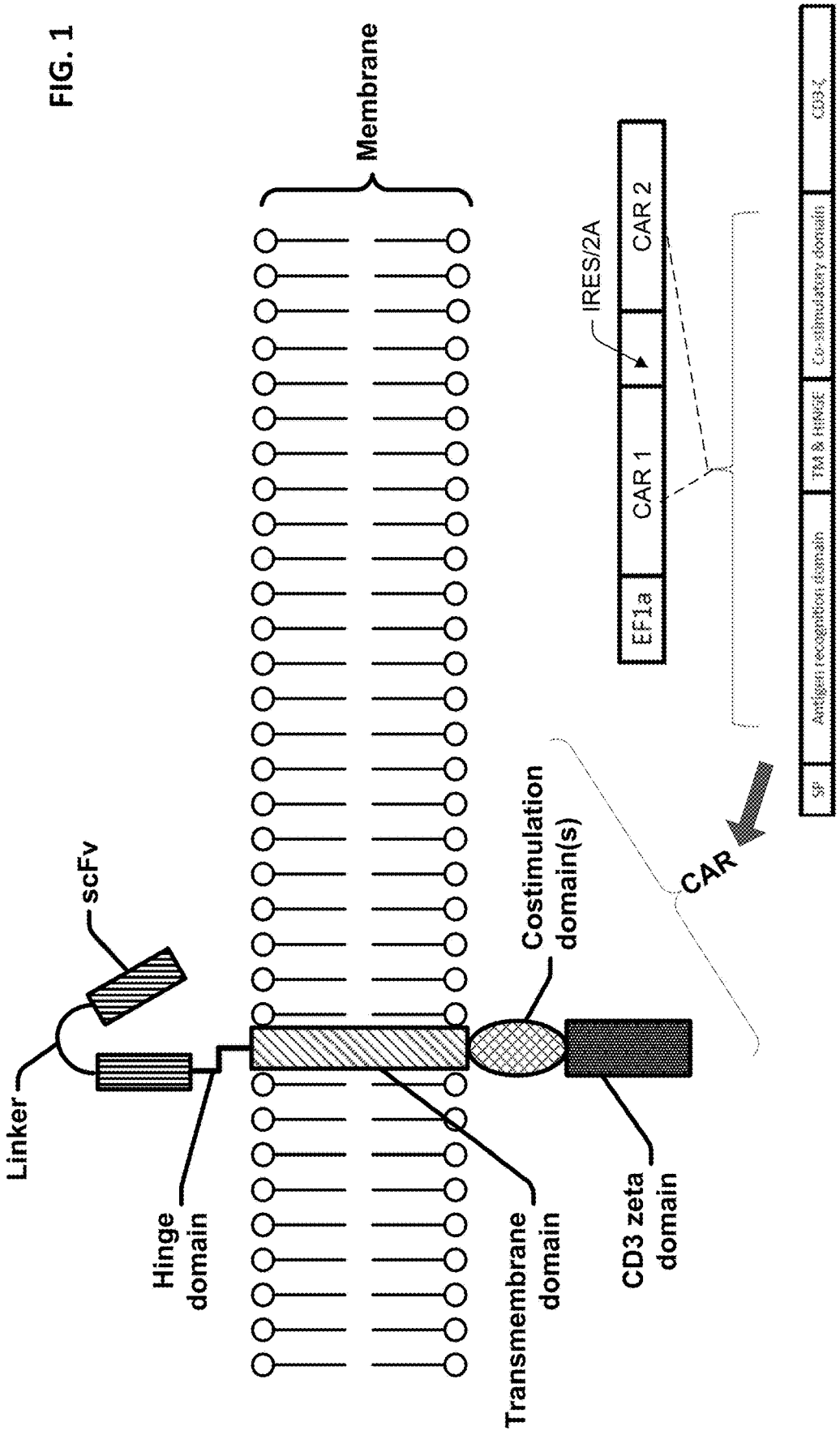
FIG. 1 is a schematic diagram of an exemplary CAR molecule and a portion of the cell membrane.
Figure 2:
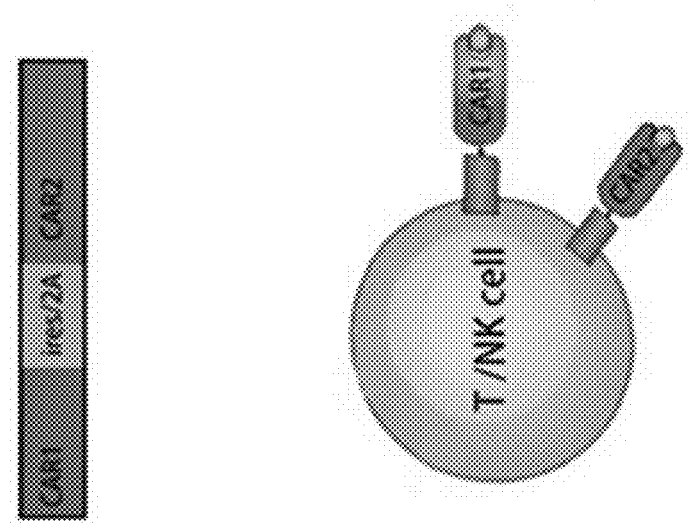
FIG. 2 is a schematic diagram of a nucleic acid construct including two CAR molecules and structures of a T cell having two different CAR molecules.
Figure 3:
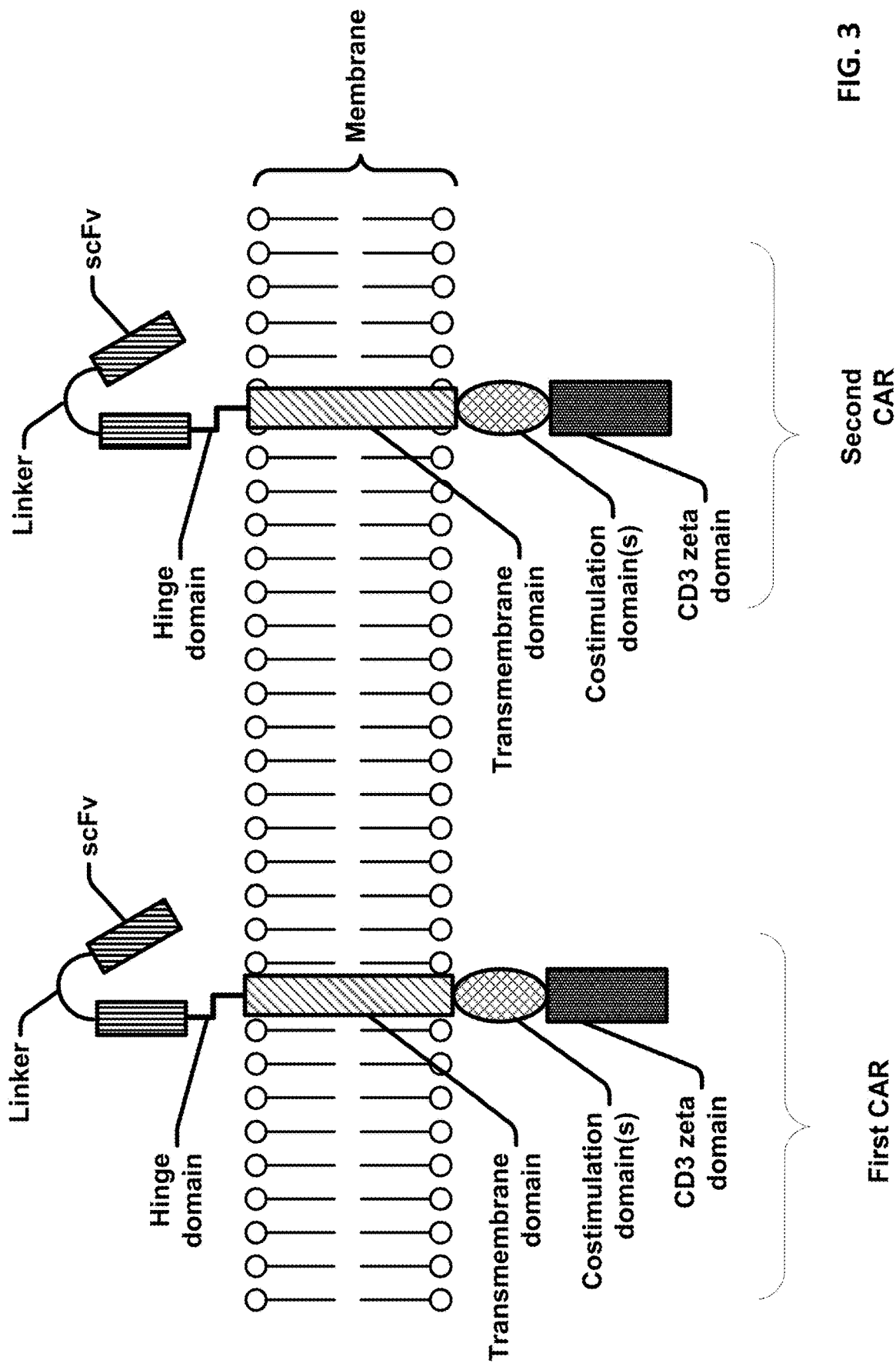
FIG. 3 is a schematic diagram showing an exemplary portion of a cell membrane comprising two CAR molecules.
Figure 4:
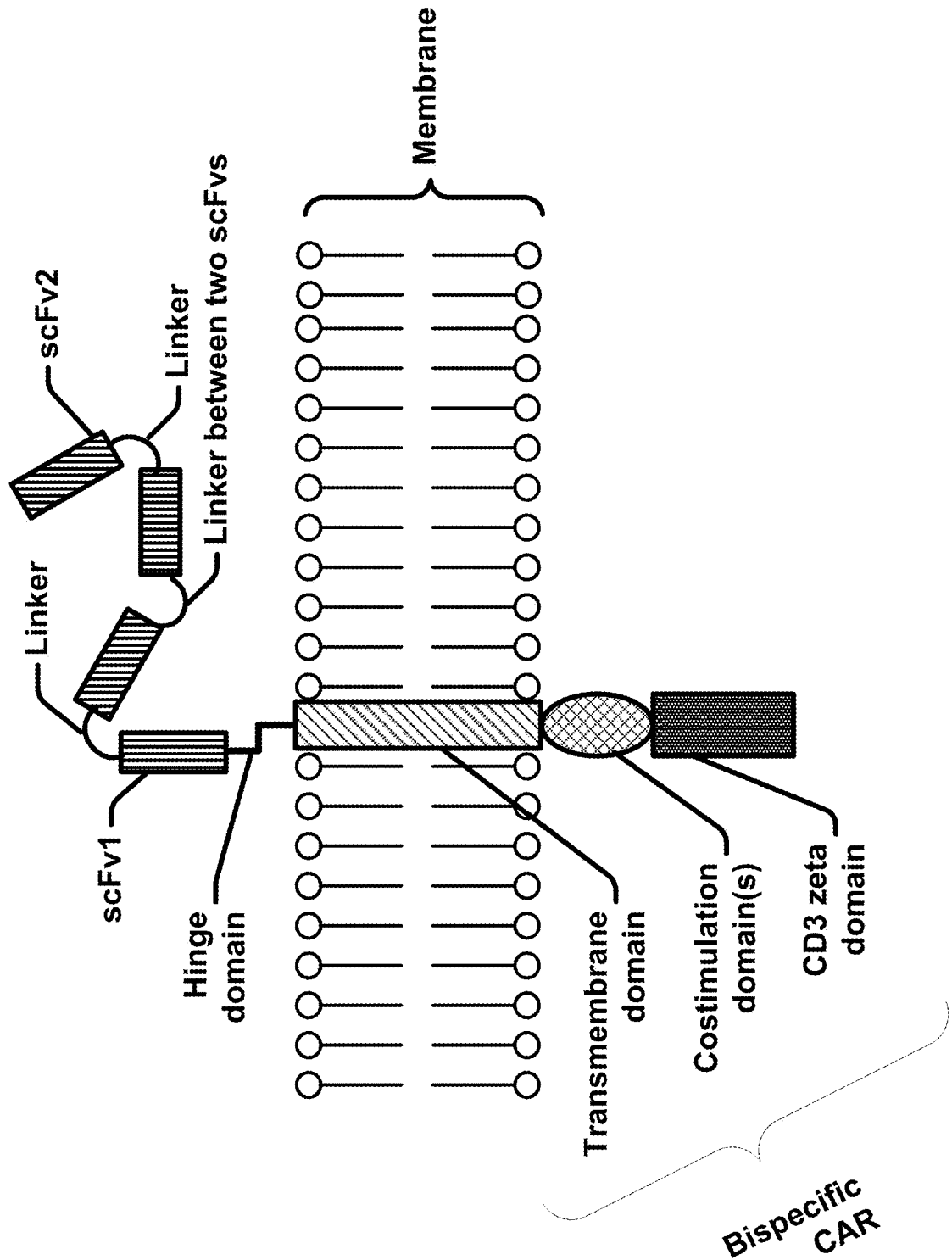
FIG. 4 is a schematic diagram showing an exemplary portion of a cell membrane comprising a bispecific CAR molecule.
Figure 5:
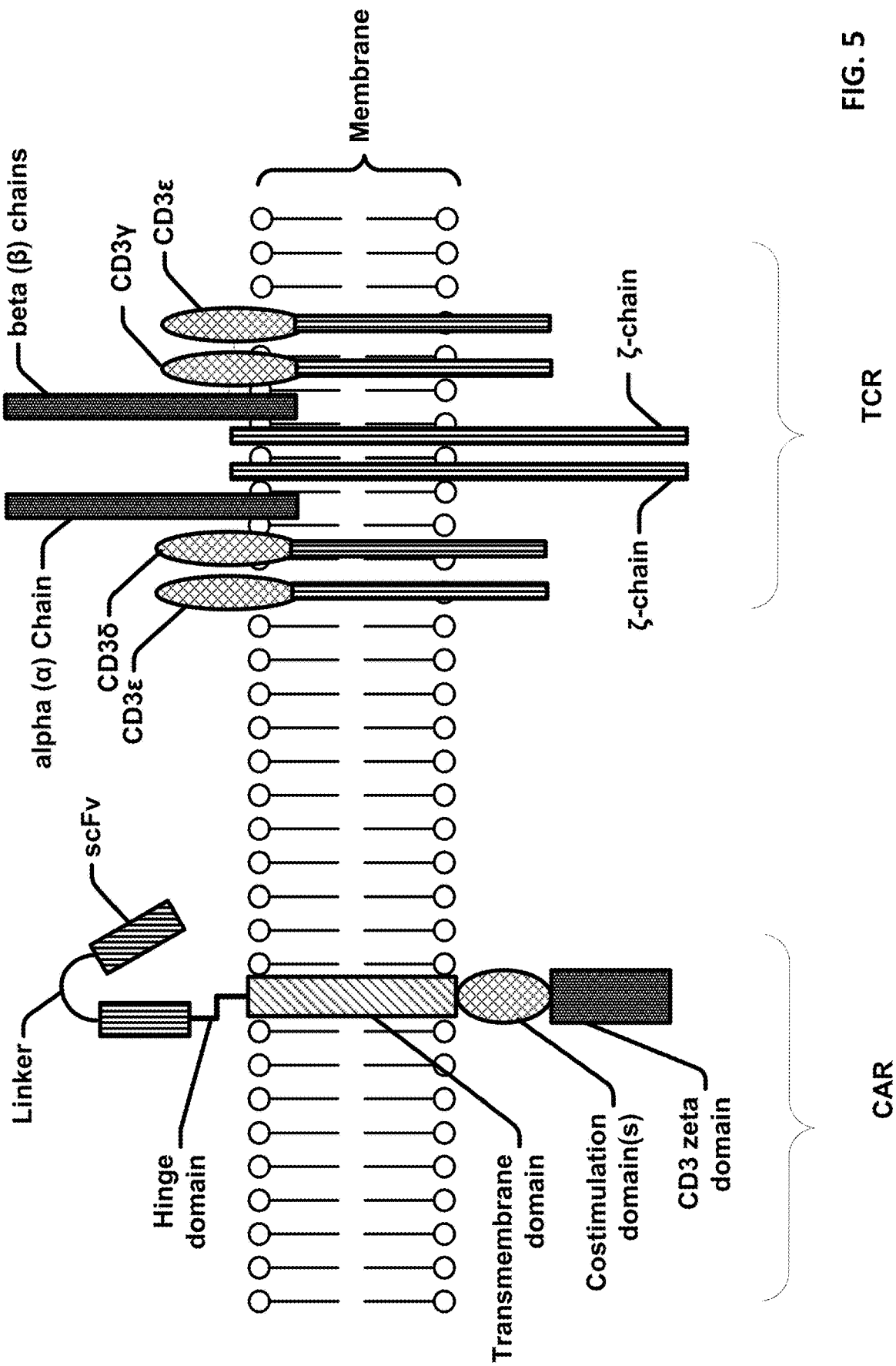
FIG. 5 is a schematic diagram showing an exemplary portion of a cell membrane comprising a bispecific CAR molecule and a T cell receptor (TCR).

Unless defined otherwise, all technical and scientific terms used herein have the same meaning as commonly understood by those of ordinary skill in the art to which the disclosure belongs. Although any method and material similar or equivalent to those described herein can be used in the practice or testing of the present disclosure, preferred methods and materials are described. For the purposes of the present disclosure, the following terms are defined below.

The articles "a" and "an" are used herein to refer to one or to more than one (i.e., to at least one) of the grammatical object of the article. By way of example, "an element" means one element or more than one element.

By "about" is meant a quantity, level, value, number, frequency, percentage, dimension, size, amount, weight or length that varies by as much as 20, 15, 10, 9, 8, 7, 6, 5, 4, 3, 2 or 1% to a reference quantity, level, value, number, frequency, percentage, dimension, size, amount, weight or length.

The term "activation," as used herein, refers to the state of a cell that has been sufficiently stimulated to induce detectable cellular proliferation. Activation can also be associated with induced cytokine production and detectable effector functions. The term "activated T cells" refers to, among other things, T cells that are undergoing cell division.

The term "antibody" is used in the broadest sense and refers to monoclonal antibodies (including full length monoclonal antibodies), polyclonal antibodies, multi-specific antibodies (e.g., bispecific antibodies), and antibody fragments so long as they exhibit the desired biological activity or function. The antibodies in the present disclosure may exist in a variety of forms including, for example, polyclonal antibodies, monoclonal antibodies, Fv, Fab and F(ab)$_2$, as well as single chain antibodies and humanized antibodies (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426).

The term "antibody fragments" refers to a portion of a full-length antibody, for example, the antigen binding or variable region of the antibody. Other examples of antibody fragments include Fab, Fab', F(ab')2, and Fv fragments; diabodies; linear antibodies; single-chain antibody molecules; and multi-specific antibodies formed from antibody fragments.

The term "Fv" refers to the minimum antibody fragment which contains a complete antigen-recognition and -binding site. This fragment consists of a dimer of one heavy- and one light-chain variable region domain in tight, non-covalent association. From the folding of these two domains emanates six hypervariable loops (3 loops each from the H and L chain) that contribute amino acid residues for antigen binding and confer antigen binding specificity to the antibody. However, even a single variable domain (or half of an Fv including only three complementarity determining regions (CDRs) specific for an antigen) has the ability to recognize and bind antigen, although at a lower affinity than the entire binding site (the dimer).

An "antibody heavy chain," as used herein, refers to the larger of the two types of polypeptide chains present in all antibody molecules in their naturally occurring conformations. An "antibody light chain," as used herein, refers to the smaller of the two types of polypeptide chains present in all antibody molecules in their naturally occurring conformations. K and λ light chains refer to the two major antibody light chain isotypes.

The term "synthetic antibody" refers to an antibody which is generated using recombinant DNA technology, such as, for example, an antibody expressed by a bacteriophage. The term also includes an antibody which has been generated by the synthesis of a DNA molecule encoding the antibody and the expression of the DNA molecule to obtain the antibody or to obtain an amino acid encoding the antibody. The synthetic DNA is obtained using technology that is available and well known in the art.

The term "antigen" refers to a molecule that provokes an immune response, which may involve either antibody production, or the activation of specific immunologically-competent cells, or both. Antigens include any macromolecule, including all proteins or peptides, or molecules derived from recombinant or genomic DNA. For example, DNA including a nucleotide sequence or a partial nucleotide sequence encoding a protein or peptide that elicits an immune response, and therefore, encodes an "antigen" as the term is used herein. An antigen need not be encoded solely by a full-length nucleotide sequence of a gene. An antigen can be generated, synthesized or derived from a biological sample including a tissue sample, a tumor sample, a cell, or a biological fluid.

The term "anti-tumor effect" as used herein, refers to a biological effect associated with a decrease in tumor volume, a decrease in the number of tumor cells, a decrease in the number of metastases, decrease in tumor cell proliferation, decrease in tumor cell survival, an increase in life expectancy of a subject having tumor cells, or amelioration of various physiological symptoms associated with the cancerous condition. An "anti-tumor effect" can also be manifested by the ability of the peptides, polynucleotides, cells, and antibodies in the prevention of the occurrence of tumor in the first place.

The term "auto-antigen" refers to an antigen mistakenly recognized by the immune system as being foreign. Autoantigens include cellular proteins, phosphoproteins, cellular surface proteins, cellular lipids, nucleic acids, glycoproteins, including cell surface receptors.

The term "autologous" is used to describe a material derived from a subject which is subsequently re-introduced into the same subject.

The term "allogeneic" is used to describe a graft derived from a different subject of the same species. As an example, a donor subject may be a related or unrelated or recipient subject, but the donor subject has immune system markers which are similar to the recipient subject.

The term "xenogeneic" is used to describe a graft derived from a subject of a different species. As an example, the donor subject is from a different species than a recipient subject, and the donor subject and the recipient subject can be genetically and immunologically incompatible.

The term "cancer" is used to refer to a disease characterized by the rapid and uncontrolled growth of aberrant cells. Cancer cells can spread locally or through the bloodstream and lymphatic system to other parts of the body. Examples of various cancers include breast cancer, prostate cancer, ovarian cancer, cervical cancer, skin cancer, pancreatic cancer, colorectal cancer, renal cancer, liver cancer, brain cancer, lymphoma, leukemia, lung cancer, and the like.

Throughout this specification, unless the context requires otherwise, the words "comprise," "includes" and "including" will be understood to imply the inclusion of a stated step or element or group of steps or elements but not the exclusion of any other step or element or group of steps or elements.

The phrase "consisting of" is meant to include, and is limited to, whatever follows the phrase "consisting of." Thus, the phrase "consisting of" indicates that the listed elements are required or mandatory and that no other elements may be present.

The phrase "consisting essentially of" is meant to include any element listed after the phrase and can include other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

The terms "complementary" and "complementarity" refer to polynucleotides (i.e., a sequence of nucleotides) related by the base-pairing rules. For example, the sequence "A-G-T," is complementary to the sequence "T-C-A." Complementarity may be "partial," in which only some of the nucleic acids' bases are matched according to the base pairing rules, or there may be "complete" or "total" complementarity between the nucleic acids. The degree of complementarity between nucleic acid strands has significant effects on the efficiency and strength of hybridization between nucleic acid strands.

The term "corresponds to" or "corresponding to" refers to (a) a polynucleotide having a nucleotide sequence that is substantially identical or complementary to all or a portion of a reference polynucleotide sequence or encoding an amino acid sequence identical to an amino acid sequence in a peptide or protein; or (b) a peptide or polypeptide having an amino acid sequence that is substantially identical to a sequence of amino acids in a reference peptide or protein.

The term "co-stimulatory ligand," refers to a molecule on an antigen presenting cell (e.g., an APC, dendritic cell, B cell, and the like) that specifically binds a cognate co-stimulatory molecule on a T cell, thereby providing a signal which, in addition to the primary signal provided by, for instance, binding of a TCR/CD3 complex with an MHC molecule loaded with peptide, mediates a T cell response, including at least one of proliferation, activation, differentiation, and other cellular responses. A co-stimulatory ligand can include B7-1 (CD80), B7-2 (CD86), PD-L1, PD-L2, 4-1BBL, OX40L, inducible co-stimulatory ligand (ICOS-L), intercellular adhesion molecule (ICAM), CD30L, CD40, CD70, CD83, HLA-G, MICA, MICB, HVEM, lymphotoxin beta receptor, 3/TR6, ILT3, ILT4, HVEM, a ligand for CD7, an agonist or antibody that binds the Toll ligand receptor and a ligand that specifically binds with B7-H3. A co-stimulatory ligand also includes, inter alia, an agonist or an antibody that specifically binds with a co-stimulatory molecule present on a T cell, such as CD27, CD28, 4-1BB, OX40, CD30, CD40, PD-1, ICOS, lymphocyte function-associated antigen-1 (LFA-1), CD2, CD7, LIGHT, NKG2C, B7-H3, and a ligand that specifically binds CD83.

The term "co-stimulatory molecule" refers to the cognate binding partner on a T cell that specifically binds with a co-stimulatory ligand, thereby mediating a co-stimulatory response by the T cell, such as proliferation. Co-stimulatory molecules include an MHC class I molecule, BTLA, and a Toll-like receptor.

The term "co-stimulatory signal" refers to a signal, which in combination with a primary signal, such as TCR/CD3 ligation, leads to T cell proliferation and/or upregulation or downregulation of key molecules. The terms "disease" and "condition" may be used interchangeably or may be different in that the particular malady or condition may not have a known causative agent (so that etiology has not yet been worked out), and it is therefore not yet recognized as a disease but only as an undesirable condition or syndrome, wherein a more or less specific set of symptoms have been identified by clinicians. The term "disease" is a state of health of a subject wherein the subject cannot maintain homeostasis, and wherein if the disease is not ameliorated then the subject's health continues to deteriorate. In contrast, a "disorder" in a subject is a state of health in which the animal is able to maintain homeostasis, but in which the animal's state of health is less favorable than it would be in the absence of the disorder. Left untreated, a disorder does not necessarily cause a further decrease in the animal's state of health.

The term "effective" refers to adequate to accomplish a desired, expected, or intended result. For example, an "effective amount" in the context of treatment may be an amount of a compound sufficient to produce a therapeutic or prophylactic benefit.

The term "encoding" refers to the inherent property of specific sequences of nucleotides in a polynucleotide, such as a gene, a cDNA, or an mRNA, to serve as a template for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence (except that a "T" is replaced by a "U") and is usually provided in sequence listings, and the non-coding strand, used as the template for transcription of a gene or cDNA, can be referred to as encoding the protein or other product of that gene or cDNA.

The term "exogenous" refers to a molecule that does not naturally occur in a wild-type cell or organism but is typically introduced into the cell by molecular biological techniques. Examples of exogenous polynucleotides include vectors, plasmids, and/or man-made nucleic acid constructs encoding the desired protein. With regard to polynucleotides and proteins, the term "endogenous" or "native" refers to naturally-occurring polynucleotide or amino acid sequences that may be found in a given wild-type cell or organism. Also, a particular polynucleotide sequence that is isolated from a first organism and transferred to a second organism by molecular biological techniques is typically considered an "exogenous" polynucleotide or amino acid sequence with respect to the second organism. In specific embodiments, polynucleotide sequences can be "introduced" by molecular biological techniques into a microorganism that already contains such a polynucleotide sequence, for instance, to create one or more additional copies of an otherwise naturally-occurring polynucleotide sequence, and thereby facilitate overexpression of the encoded polypeptide.

The term "expression" refers to the transcription and/or translation of a particular nucleotide sequence driven by its promoter.

The term "expression vector" refers to a vector including a recombinant polynucleotide including expression control sequences operably linked to a nucleotide sequence to be expressed. An expression vector includes sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

The term "homologous" refers to sequence similarity or sequence identity between two polypeptides or between two polynucleotides when a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared× 100. For example, if 6 of 10 of the positions in two sequences are matched or homologous, then the two sequences are 60% homologous. By way of example, the DNA sequences ATTGCC and TATGGC share 50% homology. A comparison is made when two sequences are aligned to give maximum homology.

The term "immunoglobulin" or "Ig," refers to a class of proteins, which function as antibodies. The five members included in this class of proteins are IgA, IgG, IgM, IgD, and IgE. IgA is the primary antibody that is present in body secretions, such as saliva, tears, breast milk, gastrointestinal secretions and mucus secretions of the respiratory and genitourinary tracts. IgG is the most common circulating antibody. IgM is the main immunoglobulin produced in the primary immune response in most subjects. It is the most efficient immunoglobulin in agglutination, complement fixation, and other antibody responses, and is important in defense against bacteria and viruses. IgD is the immunoglobulin that has no known antibody function but may serve as an antigen receptor. IgE is the immunoglobulin that mediates immediate hypersensitivity by causing the release of mediators from mast cells and basophils upon exposure to the allergen.

The term "isolated" refers to a material that is substantially or essentially free from components that normally accompany it in its native state. The material can be a cell or a macromolecule such as a protein or nucleic acid. For example, an "isolated polynucleotide," as used herein, refers to a polynucleotide, which has been purified from the sequences which flank it in a naturally-occurring state, e.g., a DNA fragment which has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment, and from association with other components of the cell.

The term "substantially purified" refers to a material that is substantially free from components that are normally associated with it in its native state. For example, a substantially purified cell refers to a cell that has been separated from other cell types with which it is normally associated in its naturally occurring or native state. In some instances, a population of substantially purified cells refers to a homogenous population of cells. In other instances, this term refers simply to a cell that has been separated from the cells with which they are naturally associated in their natural state. In embodiments, the cells are cultured in vitro. In embodiments, the cells are not cultured in vitro.

In the context of the present disclosure, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses. Vectors derived from lentiviruses offer the means to achieve significant levels of gene transfer in vivo.

The term "modulating," refers to mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation.

The term "under transcriptional control" refers to a promoter being operably linked to and in the correct location and orientation in relation to a polynucleotide to control the initiation of transcription by RNA polymerase and expression of the polynucleotide.

The term "overexpressed" tumor antigen or "overexpression" of the tumor antigen is intended to indicate an abnormal level of expression of the tumor antigen in a cell from a disease area such as a solid tumor within a specific tissue or organ of the patient relative to the level of expression in a normal cell from that tissue or organ. Patients having solid tumors or a hematological malignancy characterized by overexpression of the tumor antigen can be determined by standard assays known in the art.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme), astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma, and brain metastases).

A solid tumor antigen is an antigen expressed on a solid tumor. In embodiments, solid tumor antigen is also expressed at low levels on healthy tissue. Examples of solid tumor antigens and their related disease tumors are provided in Table 1.

TABLE 1

| Solid Tumor antigen | Disease tumor |
| --- | --- |
| PRLR | Breast Cancer |
| CLCA1 | colorectal Cancer |
| MUC12 | colorectal Cancer |
| GUCY2C | colorectal Cancer |
| GPR35 | colorectal Cancer |
| CR1L | Gastric Cancer |
| MUC 17 | Gastric Cancer |
| TMPRSS11B | esophageal Cancer |
| MUC21 | esophageal Cancer |
| TMPRSS11E | esophageal Cancer |
| CD207 | bladder Cancer |
| SLC30A8 | pancreatic Cancer |
| CFC1 | pancreatic Cancer |
| SLC12A3 | Cervical Cancer |
| SSTR1 | Cervical tumor |
| GPR27 | Ovary tumor |
| FZD10 | Ovary tumor |

TABLE 1-continued

| Solid Tumor antigen | Disease tumor |
| --- | --- |
| TSHR | Thyroid Tumor |
| SIGLEC15 | Urothelial cancer |
| SLC6A3 | Renal cancer |
| KISS1R | Renal cancer |
| QRFPR | Renal cancer: |
| GPR119 | Pancreatic cancer |
| CLDN6 | Endometrial cancer/Urothelial cancer |
| UPK2 | Urothelial cancer (including bladder cancer) |
| ADAM12 | Breast cancer, pancreatic cancer and the like |
| SLC45A3 | Prostate cancer |
| ACPP | Prostate cancer |
| MUC21 | Esophageal cancer |
| MUC16 | Ovarian cancer |
| MS4A12 | Colorectal cancer |
| ALPP | Endometrial cancer |
| CEA | Colorectal carcinoma |
| EphA2 | Glioma |
| FAP | Mesotelioma |
| GPC3 | Lung squamous cell carcinoma |
| IL13-Rα2 | Glioma |
| Mesothelin | Metastatic cancer |
| PSMA | Prostate cancer |
| ROR1 | Breast lung carcinoma |
| VEGFR-II | Metastatic cancer |
| GD2 | Neuroblastoma |
| FR-α | Ovarian carcinoma |
| ErbB2 | Carcinomasb |
| EpCAM | Carcinomasa |
| EGFRvIII | Glioma-Glioblastoma |
| EGFR | Glioma-NSCL cancer |
| tMUC 1 | Cholangiocarcinoma, Pancreatic cancer, Breast Cancer |

The term "parenteral administration" of a composition includes, e.g., subcutaneous (s.c.), intravenous (i.v.), intramuscular (i.m.), intrasternal injection, or infusion techniques.

The terms "patient," "subject," and "individual," and the like are used interchangeably herein and refer to any human, animal, or living organism, amenable to the methods described herein. In certain non-limiting embodiments, the patient, subject, or individual is a human or animal. In embodiments, the term "subject" is intended to include living organisms in which an immune response can be elicited (e.g., mammals). Examples of subjects include humans, and animals such as dogs, cats, mice, rats, and transgenic species thereof.

A subject in need of treatment or in need thereof includes a subject having a disease, condition, or disorder that needs to be treated. A subject in need thereof also includes a subject that needs treatment for prevention of a disease, condition, or disorder.

The term "polynucleotide" or "nucleic acid" refers to mRNA, RNA, cRNA, rRNA, cDNA or DNA. The term typically refers to a polymeric form of nucleotides of at least 10 bases in length, either ribonucleotides or deoxynucleotides or a modified form of either type of nucleotide. The term includes all forms of nucleic acids including single and double-stranded forms of nucleic acids.

The terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion or substitution of at least one nucleotide. Accordingly, the terms "polynucleotide variant" and "variant" include polynucleotides in which one or more nucleotides have been added or deleted or replaced with different nucleotides. In this regard, it is well understood in the art that certain alterations inclusive of mutations, additions, deletions, and substitutions can be made to a reference polynucleotide whereby the altered polynucleotide retains the biological function or activity of the reference polynucleotide or has increased activity in relation to the reference polynucleotide (i.e., optimized). Polynucleotide variants include, for example, polynucleotides having at least 50% (and at least 51% to at least 99% and all integer percentages in between, e.g., 90%, 95%, or 98%) sequence identity with a reference polynucleotide sequence described herein. The terms "polynucleotide variant" and "variant" also include naturally-occurring allelic variants and orthologs.

The terms "polypeptide," "polypeptide fragment," "peptide," and "protein" are used interchangeably herein to refer to a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers. In certain aspects, polypeptides may include enzymatic polypeptides, or "enzymes," which typically catalyze (i.e., increase the rate of) various chemical reactions.

The term "polypeptide variant" refers to polypeptides that are distinguished from a reference polypeptide sequence by the addition, deletion, or substitution of at least one amino acid residue. In certain embodiments, a polypeptide variant is distinguished from a reference polypeptide by one or more substitutions, which may be conservative or non-conservative. In certain embodiments, the polypeptide variant comprises conservative substitutions and, in this regard, it is well understood in the art that some amino acids may be changed to others with broadly similar properties without changing the nature of the activity of the polypeptide. Polypeptide variants also encompass polypeptides in which one or more amino acids have been added or deleted or replaced with different amino acid residues.

The term "promoter" refers to a DNA sequence recognized by the synthetic machinery of the cell or introduced synthetic machinery, required to initiate the specific transcription of a polynucleotide sequence. The term "expression control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

The term "bind," "binds," or "interacts with" refers to a molecule recognizing and adhering to a second molecule in a sample or organism but does not substantially recognize or adhere to other structurally unrelated molecules in the sample. The term "specifically binds," as used herein with respect to an antibody, refers to an antibody which recognizes a specific antigen, but does not substantially recognize or bind other molecules in a sample. For example, an antibody that specifically binds an antigen from one species may also bind that antigen from one or more species. But, such cross-species reactivity does not itself alter the classification of an antibody as specific. In another example, an antibody that specifically binds an antigen may also bind different allelic forms of the antigen. However, such cross reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds a specific protein structure rather than to any protein. If an antibody is specific for epitope "A," the presence of a molecule containing epitope A (or free, unlabeled A), in a reaction containing labeled "A" and the antibody, will reduce the amount of labeled A bound to the antibody.

By "statistically significant," it is meant that the result was unlikely to have occurred by chance. Statistical significance can be determined by any method known in the art. Commonly used measures of significance include the p-value, which is the frequency or probability with which the observed event would occur if the null hypothesis were true. If the obtained p-value is smaller than the significance level, then the null hypothesis is rejected. In simple cases, the significance level is defined at a p-value of 0.05 or less. A "decreased" or "reduced" or "lesser" amount is typically a "statistically significant" or a physiologically significant amount, and may include a decrease that is about 1.1, 1.2, 1.3, 1.4, 1.5, 1.6 1.7, 1.8, 1.9, 2, 2.5, 3, 3.5, 4, 4.5, 5, 6, 7, 8, 9, 10, 15, 20, 30, 40, or 50 or more times (e.g., 100, 500, 1000 times) (including all integers and decimal points in between and above 1, e.g., 1.5, 1.6, 1.7. 1.8, etc.) an amount or level described herein.

The term "stimulation," refers to a primary response induced by binding of a stimulatory molecule (e.g., a TCR/CD3 complex) with its cognate ligand thereby mediating a signal transduction event, such as signal transduction via the TCR/CD3 complex. Stimulation can mediate altered expression of certain molecules, such as downregulation of TGF-$\beta$, and/or reorganization of cytoskeletal structures.

The term "stimulatory molecule" refers to a molecule on a T cell that specifically binds a cognate stimulatory ligand present on an antigen presenting cell. For example, a functional signaling domain derived from a stimulatory molecule is the zeta chain associated with the T cell receptor complex.

The term "stimulatory ligand" refers to a ligand that when present on an antigen presenting cell (e.g., an APC, a dendritic cell, a B-cell, and the like.) can specifically bind with a cognate binding partner (referred to herein as a "stimulatory molecule") on a cell, for example a T cell, thereby mediating a primary response by the T cell, including activation, initiation of an immune response, proliferation, and similar processes. Stimulatory ligands are well-known in the art and encompass, inter alia, an MHC Class I molecule loaded with a peptide, an anti-CD3 antibody, a superagonist anti-CD28 antibody, and a superagonist anti-CD2 antibody.

The term "therapeutic" refers to a treatment and/or prophylaxis. A therapeutic effect is obtained by suppression, remission, or eradication of a disease state or alleviating the symptoms of a disease state.

The term "therapeutically effective amount" refers to the amount of the subject compound that will elicit the biological or medical response of a tissue, system, or subject that is being sought by the researcher, veterinarian, medical doctor or another clinician. The term "therapeutically effective amount" includes that amount of a compound that, when administered, is sufficient to prevent the development of, or alleviate to some extent, one or more of the signs or symptoms of the disorder or disease being treated. The therapeutically effective amount will vary depending on the compound, the disease and its severity and the age, weight, etc., of the subject to be treated.

The term "treat a disease" refers to the reduction of the frequency or severity of at least one sign or symptom of a disease or disorder experienced by a subject.

The term "transfected" or "transformed" or "transduced" refers to a process by which an exogenous nucleic acid is transferred or introduced into the host cell. A "transfected" or "transformed" or "transduced" cell is one which has been transfected, transformed, or transduced with exogenous nucleic acid. The cell includes the primary subject cell and its progeny.

The term "vector" refers to a polynucleotide that comprises an isolated nucleic acid and which can be used to deliver the isolated nucleic acid to the interior of a cell. Numerous vectors are known in the art including linear polynucleotides, polynucleotides associated with ionic or amphiphilic compounds, plasmids, and viruses. Thus, the term "vector" includes an autonomously replicating plasmid or a virus. The term also includes non-plasmid and non-viral compounds which facilitate the transfer of nucleic acid into cells, such as, for example, polylysine compounds, liposomes, and the like. Examples of viral vectors include adenoviral vectors, adeno-associated virus vectors, retroviral vectors, and others. For example, lentiviruses are complex retroviruses, which, in addition to the common retroviral genes gag, pol, and env, contain other genes with regulatory or structural function. Lentiviral vectors are well known in the art. Some examples of lentivirus include the Human Immunodeficiency Viruses: HIV-1, HIV-2, and the Simian Immunodeficiency Virus: SIV. Lentiviral vectors have been generated by multiply attenuating the HIV virulence genes, for example, the genes env, vif, vpr, vpu, and nef are deleted making the vector biologically safe.

Ranges: throughout this disclosure, various aspects of the disclosure can be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

A "chimeric antigen receptor" (CAR) molecule is a recombinant polypeptide including at least an extracellular domain, a transmembrane domain and a cytoplasmic domain or intracellular domain. In embodiments, the domains of the CAR are on the same polypeptide chain, for example a chimeric fusion protein. In embodiments, the domains are on different polypeptide chains, for example the domains are not contiguous.

The extracellular domain of a CAR molecule includes an antigen binding domain. In embodiments, the antigen binding domain binds an antigen, for example, a cell surface molecule or marker, on the surface of a B cell. In embodiments, the cell surface molecule of a B cell includes CD19, CD22, CD20, BCMA, CD5, CD7, CD2, CD16, CD56, CD30, CD14, CD68, CD11b, CD18, CD169, CD1c, CD33, CD38, CD138, or CD13. In embodiments, the cell surface molecule of the B cell is CD19, CD20, CD22, or BCMA. In particular embodiments, the cell surface molecule of the B cell is CD19.

In embodiments, the antigen binding domain binds an antigen, on the surface of a tumor for example a tumor antigen or tumor marker. Tumor antigens are proteins that are produced by tumor cells that elicit an immune response, particularly T cell mediated immune responses. Tumor antigens are well known in the art and include, for example, tumor associated MUC1, a glioma-associated antigen, carcinoembryonic antigen (CEA), β-human chorionic gonadotropin, alphafetoprotein (AFP), lectin-reactive AFP, thyroglobulin, RAGE-1, MN-CA IX, human telomerase reverse transcriptase, RU1, RU2 (AS), intestinal carboxyl esterase, mut hsp70-2, M-CSF, prostase, prostate-specific antigen (PSA), PAP, NY-ESO-1, LAGE-1a, p53, prostein, PSMA, Her2/neu, surviving, telomerase, prostate-carcinoma tumor antigen-1 (PCTA-1), MAGE, ELF2M, neutrophil elastase, ephrinB2, CD22, insulin growth factor (IGF)-I, IGF-II, IGF-I receptor and mesothelin. For example, when the tumor antigen is CD19, and the CAR thereof can be referred to as CD19CAR.

In embodiments, the extracellular antigen binding domain of a CAR includes at least one scFv or at least a single domain antibody. As an example, there can be two scFvs on a CAR. The scFv includes a light chain variable (VL) region and a heavy chain variable (VH) region of a target antigen-specific monoclonal antibody joined by a flexible linker. Single chain variable region fragments can be made by linking light and/or heavy chain variable regions by using a short linking peptide (Bird et al., Science 242:423-426, 1988). An example of a linking peptide is the GS linker having the amino acid sequence (GGGGS)3 (SEQ ID NO: 278), which bridges approximately 3.5 nm between the carboxy terminus of one variable region and the amino terminus of the other variable region. Linkers of other sequences have been designed and used (Bird et al., 1988, supra). In general, linkers can be short, flexible polypeptides and preferably comprised of about 20 or fewer amino acid residues. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as E. coli. Polynucleotides encoding the scFv of interest can be made by routine manipulations such as ligation of polynucleotides. The resultant scFv can be isolated using standard protein purification techniques known in the art.

The cytoplasmic domain of the CAR molecules described herein includes one or more co-stimulatory domains and one or more signaling domains. The co-stimulatory and signaling domains function to transmit the signal and activate molecules, such as T cells, in response to antigen binding. The one or more co-stimulatory domains are derived from stimulatory molecules and/or co-stimulatory molecules, and the signaling domain is derived from a primary signaling domain, such as the CD3 zeta domain. In embodiments, the signaling domain further includes one or more functional signaling domains derived from a co-stimulatory molecule. In embodiments, the co-stimulatory molecules are cell surface molecules (other than antigens receptors or their ligands) that are required for activating a cellular response to an antigen.

In embodiments, the co-stimulatory domain includes the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or any combination thereof. In embodiments, the signaling domain includes a CD3 zeta domain derived from a T cell receptor.

In embodiments, the cytoplasmic domain of the CAR only includes one or more stimulatory domains and no signaling domain.

The CAR molecules also include a transmembrane domain. The incorporation of a transmembrane domain in the CAR molecules stabilizes the molecule. In embodiments, the transmembrane domain of the CAR molecules is the transmembrane domain of a CD28 or 4-1BB molecule.

Between the extracellular domain and the transmembrane domain of the CAR, there may be incorporated a spacer domain. As used herein, the term "spacer domain" generally means any oligo- or polypeptide that functions to link the transmembrane domain to, either the extracellular domain or, the cytoplasmic domain on the polypeptide chain. A spacer domain may include up to 300 amino acids, preferably 10 to 100 amino acids, and most preferably 25 to 50 amino acids.

The present disclosure describes isolated nucleic acids encoding at least two different antigen binding domains. In embodiments, there is a first antigen binding domain that binds an antigen on the surface of a WBC, and there is a second antigen binding domain that binds an antigen on a tumor that is different from the antigen on the surface of a WBC. The first antigen binding domain functions to expand the cells that it is introduced into, while the second antigen binding domain functions to inhibit the growth of or kill tumor cells containing the target tumor antigen upon binding to the target antigen. In embodiments, an isolated nucleic acid described herein encodes both the first and second antigen binding domains on the same nucleic acid molecule. In embodiments, the two antigen binding domains are encoded by two separate nucleic acid molecules. For example, a first nucleic acid encodes a first antigen binding domain and a second nucleic acid encodes a second antigen binding domain.

In embodiments, the present disclosure describes nucleic acids encoding a first antigen binding domain of a binding molecule and a second antigen binding domain of a binding molecule, wherein first antigen binding domain binds a cell surface molecule of a WBC, and the second antigen binding domain binds an antigen different from the cell surface molecule of the WBC. In embodiments, the second binding domain does not bind a B cell marker. In embodiments, the second binding domain includes a scFv comprising an amino acid sequence of SEQ ID No: 264 or 265. For example, the second antigen binding domain is on a CAR having one of the amino acid sequences of SEQ ID Nos: 271-277.

In embodiments, the first and second antigen binding domains can be on two different binding molecules (first and second binding molecules) such as a first CAR and a second CAR. As an example, a first CAR includes an extracellular binding domain that binds a marker on the surface of a B cell, and a second CAR includes an extracellular binding domain that binds a target antigen of a tumor cell. In embodiments, the first CAR and second CAR are encoded by different nucleic acids. In embodiments, the first CAR and second CAR are two different binding molecules but are encoded by a single nucleic acid.

In embodiments, the two different antigen binding domains can be on the same binding molecule, for example on a bispecific CAR, and encoded by a single nucleic acid. In embodiments, the bispecific CAR can have two different scFv molecules joined together by linkers.

In embodiments, the two different antigen binding domains can be on a CAR and a T cell receptor (TCR) and are encoded by separate nucleic acids. The binding domain of a TCR can target a specific tumor antigen or tumor marker on the cell of a tumor. In embodiments the TCR binding domain is a TCR alpha binding domain or TCR beta binding domain that targets a specific tumor antigen. In embodiments, the TCR comprises the TCRγ and TORδ chains or the TCRα and TCRβ chains.

The present disclosure also describes vectors including the isolated nucleic acids described above. In embodiments, a single vector contains the isolated nucleic acid encoding the first CAR and second CAR or TCR. In embodiments, a first vector contains the first nucleic acid encoding a first CAR, a second vector contains the nucleic acid encoding the second CAR or TCR. In embodiments, the vector comprises a bispecific CAR including at least two antigen binding domains.

Moreover, the present disclosure describes cells comprising the isolated nucleic acids or vectors described above. The cells have been introduced with the isolated nucleic acids or vectors described herein and express at least two more different binding domains. In embodiments, the cells include a first antigen binding domain and a second antigen binding domain, wherein the first antigen binding domain binds a cell surface molecule of a WBC, and the second antigen binding domain binds an antigen different from the cell surface molecule of a WBC. Further, the present disclosure describes compositions including a population of the cells described herein. In embodiments, the cells are lymphocytes. In particular embodiments, the lymphocytes are T cells, NK cell, or dendritic cells.

The present disclosure also describes methods of culturing cells described above. The methods described herein includes obtaining a cell comprising a first antigen binding domain and a second antigen binding domain, wherein the first antigen binding domain binds a cell surface molecule of a WBC, and the second antigen binding domain binds an antigen different from the cell surface molecule of the WBC; and culturing the cell in the presence of an agent derived from a cell surface molecule of the WBC or from an antigen to which the second antigen binding domain binds. In embodiments, the agent is an extracellular domain of a cell surface molecule of a WBC.

The present disclose describes methods for in vitro cell preparation, wherein the method includes providing cells; introducing one or more nucleic acids encoding a first antigen binding domain and a second antigen binding domain into the cells, wherein the first antigen binding domain binds a cell surface molecule of a WBC, and the second antigen binding domain binds an antigen different from the cell surface molecule of the WBC; and culturing the cells in the presence of an agent derived from the cell surface molecule of the WBC or from an antigen to which the second antigen binding domain binds.

The present disclosure describes using the prepared cells preparation to enhance T cell expansion in a subject having cancer. In embodiments, the method comprises introducing a plurality of nucleic acids into T cells, the plurality of nucleic acids encoding a chimeric antigen receptor (CAR) binding a solid tumor antigen and encoding a CAR binding a B cell antigen, at least a portion of the T cells comprising the CAR binding the solid tumor antigen and the CAR binding the B cell antigen; and administering an effective amount of the T cells to the subject.

Additionally, the present disclosure describes methods for introducing and/or enhancing lymphocyte (T cell) response in a subject. Embodiments described herein involve a mechanism that expands lymphocytes and a mechanism that relates to binding of an antigen on a CAR to a tumor cell. In embodiments, the first mechanism involves a molecule associated with a signal that is involved in expanding the lymphocytes in a subject, and an additional mechanism involves a molecule associated with a signal directed to binding, inhibiting the growth of, or killing a tumor cell in the subject. For example, the first mechanism includes a CAR binding to an antigen associated with blood, such as blood cells and blood plasma, or non-essential tissues, and the additional mechanism includes a CAR or TCR targeting an antigen associated with the tumor cell. Examples of non-essential tissues include the mammary gland, colon, gastric gland, ovary, blood components, such WBC, and thyroid. In embodiments, the first mechanism involves a first binding domain of a molecule, and the additional mechanism involves a second domain of a molecule. In embodiments, the first mechanism and the additional mechanism are performed by the same molecule or by separate molecules. In particular embodiments, the mechanism involves a cell expressing an antigen associated with a tumor cell, and the additional mechanism involves a lymphocyte having an antigen binding domain.

The methods described herein involves lymphocytes including an expansion molecule and a function molecule. In embodiments, the expansion molecule expands the lymphocytes in a subject, and/or the function molecule inhibits the growth of or kills a tumor cell in the subject. In embodiments, the expansion molecule and the function molecule are on a single CAR molecule, for example a bispecific CAR molecule. In embodiments, the expansion molecule and the function molecule are on separate molecules, for example, CAR and TCR or two different CARs. The expansion molecule can include a CAR binding to an antigen associated with blood (e.g., blood cells and blood plasma) or non-essential tissues, and the function molecule can include a CAR or TCR targeting an antigen associated with the tumor cell.

Lymphocyte or T cell response in a subject refers to cell-mediated immunity associated with a helper, killer, regulatory, and other types of T cells. For example, T cell response may include activities such as assisting other WBCs in immunologic processes and identifying and destroying virus-infected cells and tumor cells. T cell response in the subject can be measured via various indicators such as a number of virus-infected cells and/or tumor cells that T cells kill, the amount of cytokine that T cells release in co-culturing with virus-infected cells and/or tumor cells, a level of proliferation of T cells in the subject, a phenotype change of T cells, for example, changes to memory T cells, and a level longevity or lifetime of T cells in the subject.

In embodiments, the method of enhancing T cell response treats a subject in need thereof, for example, a subject diagnosed with a tumor. The term tumor refers to a mass, which can be a collection of fluid, such as blood, or a solid mass. A tumor can be malignant (cancerous) or benign. Examples of blood cancers include chronic lymphocytic leukemia, acute myeloid leukemia, acute lymphoblastic leukemia, and multiple myeloma.

Solid tumors usually do not contain cysts or liquid areas. The major types of malignant solid tumors include sarcomas and carcinomas. Sarcomas are tumors that develop in soft tissue cells called mesenchymal cells, which can be found in blood vessels, bone, fat tissues, ligament lymph vessels, nerves, cartilage, muscle, ligaments, or tendon, while carcinomas are tumors that form in epithelial cells, which are found in the skin and mucous membranes. The most common types of sarcomas include undifferentiated pleomorphic sarcoma which involves soft tissue and bone cells; leiomyosarcoma which involves smooth muscle cells that line blood vessels, gastrointestinal tract, and uterus; osteosarcoma which involves bone cells, and liposarcoma which involves fat cells. Some examples of sarcomas include Ewing sarcoma, Rhabdomyosarcoma, chondosarcoma, mesothelioma, fibrosarcoma, fibrosarcoma, and glioma.

The five most common carcinomas include adrenocarcinoma which involves organs that produce fluids or mucous, such as the breasts and prostate; basal cell carcinoma which involves cells of the outer-most layer of the skin, for example, skin cancer; squamous cell carcinoma which involves the basal cells of the skin; and transitional cell carcinoma which affects transitional cells in the urinary tract which includes the bladder, kidneys, and ureter. Examples of carcinomas include cancers of the thyroid, breast, prostate, lung, intestine, skin, pancreas, liver, kidneys, and bladder, and cholangiocarcinoma.

The methods described herein can be used to treat a subject diagnosed with cancer. The cancer can be a blood cancer or can be a solid tumor, such as a sarcoma or carcinoma. The method of treating includes administering an effective amount of T cells comprising a first antigen binding domain and a second antigen binding domain to the subject to provide a T-cell response, wherein the first antigen binding domain binds a cell surface molecule of a WBC, and the second antigen binding domain binds an antigen different from the cell surface molecule of the WBC. In embodiments, enhancing the T cell response in the subject includes selectively enhancing proliferation of T cell expressing the first antigen binding domain and the second antigen binding domain in vivo.

In embodiments, the T cells for enhancing T cell response in a subject includes administering to the subject, T cells comprising a bispecific CAR including two different binding domains or administering T cells comprising a first CAR and a second CAR, wherein the first CAR and the second CAR, each includes a different antigen binding domain.

In embodiments, methods for enhancing T cell response in a subject includes administering a T cell including a CAR molecule and a TCR molecule. The CAR molecule targets or binds a surface marker of a white blood cell, and the TCR molecule binds a marker or an antigen of the tumor that is expressed on the surface or inside the tumor cell.

The present disclosure describes methods of expanding cells expressing an antigen binding domain in vivo. The method includes administering an effective amount of T cells comprising a first antigen binding domain and a second antigen binding domain to a subject in need thereof, wherein the first antigen binding domain binds a cell surface molecule of a WBC, and the second antigen binding domain binds an antigen different from the cell surface molecule of the WBC. The methods are useful for expanding T cells, NK cells, or dendritic cells.

In embodiments, the first antigen binding domain is on a first chimeric antigen receptor (CAR) and the second antigen binding domain is on a second CAR or a TCR. For example, the first CAR and the second CAR or TCR include an extracellular antigen binding domain, a transmembrane domain, and a cytoplasmic domain. The cytoplasmic domain of the first CAR include a co-stimulatory domain and a CD3 zeta domain for transmitting signals for activation of cellular responses. In embodiments, the cytoplasmic domain of the first CAR includes one or more co-stimulatory domains in the absence of a CD3 zeta domain such that activation or stimulation of the first CAR expands WBCs, such as lymphocytes, without introducing and/or activating the killing function of the WBCs. In embodiments, the lymphocytes are T cells.

In embodiments, the first and second antigen binding domains are on the same CAR (the first CAR), for example, a bispecific CAR with an extracellular antigen binding domain, a transmembrane domain, and a cytoplasmic domain. The extracellular antigen binding domain includes at least two scFvs and at least one of the scFvs function as a first antigen binding domain for binding a cell surface molecule of a WBC.

In embodiments, the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Ra2 (zetakine), Kappa, Leukemia, LewisY, Mesothelin, MUC1, NKG2D, NY-ESO-1, PSMA, ROR-1, TRAIL-receptor1, or VEGFR2.

In embodiments, the MUC1 is a tumor-exclusive epitope of a human MUC1, and the first CAR and the second CAR or the TCR are expressed as separate polypeptides. In embodiments, the MUC1 is a tumor form of human MUC1 (tMUC1).

In embodiments, the first CAR includes a co-stimulatory domain without a signaling domain, such as the CD3 zeta domain, and the MUC1 CAR (second CAR) comprises the MUC1 binding domain, a transmembrane domain, a co-stimulatory, and a CD3 zeta domain.

As used herein, the term "MUC1" refers to a molecule defined as follows. MUC1 is one of the epithelial mucin family of molecules. MUC1 is a transmembrane mucin glycoprotein that is normally expressed on all glandular epithelial cells of the major organs. In normal cells, MUC1 is only expressed on the apical surface and is heavily glycosylated with its core proteins sequestered by the carbohydrates. As cells transform to a malignant phenotype, expression of MUC1 increases several folds, and the expression is no longer restricted to the apical surface, but it is found all around the cell surface and in the cytoplasm. In addition, the glycosylation of tumor associated MUC1 is aberrant, with greater exposure of the peptide core than is found on MUC1 expressed in normal tissues. Little is known regarding the specifics of the aberrant glycosylation.

MUC1 is widely expressed on a large number of epithelial cancers and is aberrantly glycosylated making it structurally and antigenically distinct from that expressed by non-malignant cells (see, e.g., Barratt-Boyes, 1996; Price et al., 1998; Peterson et al., 1991). The dominant form of MUC1 is a high molecular weight molecule comprising a large highly immunogenic extracellular mucin-like domain with a large number of twenty amino acid tandem repeats, a transmembrane region, and a cytoplasmic tail (Quin et al., 2000; McGucken et al., 1995; Dong et al., 1997).

In most epithelial adenocarcinomas including breast and pancreas, MUC1 is overexpressed and aberrantly glycosylated. Adenocarcinoma of the breast and pancreas not only overexpress MUC1 but also shed MUC1 into the circulation. High MUC1 serum levels are associated with progressive disease. MUC1 has been exploited as a prospective biomarker because of the complex and heterogeneous nature of the epitopes expressed within the antigen. MUC1 synthesized by cancerous tissues (e.g., tumor associated MUC1) usually displays an aberrant oligosaccharide profile, which gives rise to the expression of neomarkers such as sialyl-Lea (assayed in the CA19-9 test), sialyl-Lex, and sialyl-Tn (TAG-72), as well as the cryptic epitopes such as Tn.

Several antibodies are being developed against MUC1 for therapeutic use. Pemtumomab (also known as HMFG1) is in Phase III clinical trials as a carrier to deliver the radioisotope Yttrium-90 into tumors in ovarian cancer (reviewed in Scott et al., 2012). CA15-3 (also the HMFG1 antibody), CA27-29, and CA19-9 are all antibodies to MUC1 that are used to assess levels of circulating MUC1 in patients with cancer. However, these antibodies have shown limited utility as therapeutic agents or as biomarkers because they cannot distinguish effectively between MUC1 expressed on normal versus transformed tumor epithelia. In other words, none of these antibodies appear to be targeted to a tumor-specific MUC1 epitope.

A new antibody that is highly specific for a tumor-specific form of MUC1 (tMUC) is designated TAB-004 and is described in U.S. Pat. No. 8,518,405 (see also Curry et al., 2013). While Pemtumomab (HMFG1) was developed using human milk fat globules as the antigen (Parham et al., 1988), TAB-004 was developed using tumors expressing an altered form of MUC1 (Tinder et al., 2008). TAB-004 recognizes the altered glycosylated epitope within the MUC1 tandem repeat sequence. This area is accessible for antigenic detection in tMUC but is blocked from antigenic detection in normal MUC1 by large branches of glycosylation (Gendler, 2001; Mukherjee et al., 2003b; Hollingsworth & Swanson, 2004; Kufe, 2009). Importantly, TAB-004 is different from the epitopes recognized by other MUC1 antibody and has unique complementary determinant regions (CDRs) of the heavy and light chains. The antibody binds the target antigen with a high binding affinity at 3 ng/ml (20 pM) and does not bind unrelated antigens (Curry et al., 2013). Thus, TAB-004 distinguishes between normal and tumor form of MUC1 while HMFG1 (Pemtumomab) does not (see U.S. Pat. No. 8,518,405).

In embodiments, the WBC is a granulocyte, monocyte and or lymphocyte. In embodiments, the WBC is a B cell.

In embodiments, the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

In embodiments, the antigen binding domain is a Fab or a scFv. In embodiments, the first CAR comprises the amino acid sequence of one of SEQ ID NO: 5, 6, and 53-58; and the second CAR comprises the amino acid sequence of one of SEQ ID NOs: 5-17, 29, 33, 37, 71, and 72, or the amino acid sequence encoded by the nucleic acid sequence of one of SEQ ID Nos: 41, 45, 63, 67, and 68. In embodiments, a nucleic acid sequence encoding the first CAR comprises the nucleic acid sequence of SEQ ID NO: 59 or 60, and a nucleic acid sequence encoding the second CAR comprises the nucleic acid sequence of SEQ ID NO: 61. In embodiments, the isolated nucleic acid comprises one of the nucleic acid sequence of SEQ ID NO: 62-69. In embodiments, the first CAR and the second CAR are expressed as separate polypeptides.

In embodiments, the first antigen binding domain is on a CAR and the second antigen binding domain is on a T Cell Receptor (TCR). In embodiments, the TCR is a modified TCR. In embodiments, the TCR is derived from spontaneously occurring tumor-specific T cells in patients. In embodiments, the TCR binds a tumor antigen. In embodiments, the tumor antigen comprises CEA, gp100, MART-1, p53, MAGE-A3, or NY-ESO-1.

In embodiments, a T cell clone that expresses a TCR with high affinity for the target antigen may be isolated. Tumor-infiltrating lymphocytes (TILs) or peripheral blood mononuclear cells (PBMCs) can be cultured in the presence of antigen-presenting cells (APCs) pulsed with a peptide representing an epitope known to elicit a dominant T cell response when presented in the context of a defined HLA allele. High-affinity clones may be then be selected on the basis of MHC-peptide tetramer staining and/or the ability to recognize and lyse target cells pulsed with low titrated concentrations of cognate peptide antigen. After the clone has been selected, the TCRα and TCRβ chains or TCRγ and TORδ chains are identified and isolated by molecular cloning. For example, for TCRα and TCRβ chains, the TCRα and TCRβ gene sequences are then used to generate an expression construct that ideally promotes stable, high-level expression of both TCR chains in human T cells. The transduction vehicle, for example, a gammaretrovirus or lentivirus, can then be generated and tested for functionality (antigen specificity and functional avidity) and used to produce a clinical lot of the vector. An aliquot of the final product can then be used to transduce the target T cell population (generally purified from patient PBMCs), which is expanded before infusion into the patient.

Various methods may be implemented to obtain genes encoding tumor-reactive TCR. More information is provided in Kershaw et al., Clin Transl Immunology. 2014 May; 3(5): e16. In embodiments, specific TCR can be derived from spontaneously occurring tumor-specific T cells in patients. Antigens included in this category include the melanocyte differentiation antigens MART-1 and gp100, as well as the MAGE antigens and NY-ESO-1, with expression in a broader range of cancers. TCRs specific for viral-associated malignancies can also be isolated, as long as viral proteins are expressed by transformed cells. Malignancies in this category include liver and cervical cancer, associated with hepatitis and papilloma viruses, and Epstein-Barr virus-associated malignancies. In embodiments, target antigens of the TCR may include CEA (e.g., for colorectal cancer), gp100, MART-1, p53 (e.g., for Melanoma), MAGE-A3 (e.g., Melanoma, esophageal and synovial sarcoma), NY-ESO-1 (e.g., for Melanoma and sarcoma as well as Multiple myelomas).

In embodiments, a binding domain of the first CAR binds CD19, and a binding domain of the second CAR binds tumor associated MUC1. In embodiments, the binding domain of the second CAR comprises: (i) a heavy chain complementary determining region 1 comprising the amino acid sequence of SEQ ID: 76 or 85, a heavy chain complementary determining region 2 comprising the amino acid sequence of SEQ ID: 77 or 86, and a heavy chain complementary determining region 3 comprising the amino acid sequence of SEQ ID: 78 or 87; and (ii) a light chain complementary determining region 1 comprising the amino acid sequence of SEQ ID: 73 or 82, a light chain complementary determining region 2 comprising the amino acid sequence of TRP-ALA-SER (WAS) or SEQ ID: 83, and a light chain complementary determining region 3 comprising the amino acid sequence of SEQ ID: 75 or 84.

In embodiments, the binding domain of the second CAR comprises: (i) a heavy chain complementary determining region 1 comprising the amino acid sequence of SEQ ID: 76, a heavy chain complementary determining region 2 comprising the amino acid sequence of SEQ ID: 77, and a heavy chain complementary determining region 3 comprising the amino acid sequence of SEQ ID: 78; and (ii) a light chain complementary determining region 1 comprising the amino acid sequence of SEQ ID: 73, a light chain complementary determining region 2 comprising the amino acid sequence of TRP-ALA-SER (WAS), and a light chain complementary determining region 3 comprising the amino acid sequence of SEQ ID: 75.

In embodiments, the binding domain of the second CAR comprises: (i) a heavy chain complementary determining region 1 comprising the amino acid sequence of SEQ ID: 85, a heavy chain complementary determining region 2 comprising the amino acid sequence of SEQ ID: 86, and a heavy chain complementary determining region 3 comprising the amino acid sequence of SEQ ID: 87; and (ii) a light chain complementary determining region 1 comprising the amino acid sequence of SEQ ID: 82, a light chain complementary determining region 2 comprising the amino acid sequence of SEQ ID: 83, and a light chain complementary determining region 3 comprising the amino acid sequence of SEQ ID: 84. In embodiments, the binding domain of the first CAR comprises the amino acid sequence of SEQ ID: 5 or 6. In embodiments, the binding domain of the second CAR comprises one of the amino acid sequences of SEQ ID: 70-72 and 79-81.

In embodiments, the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

In embodiments, the first CAR and the second CAR are expressed as separate polypeptides.

In embodiments, the cytoplasmic domain or the transmembrane domain of the second CAR is modified such that the second CAR is capable of activating the modified T cell via cells expressing CD19 without damaging the cells expressing CD19.

Embodiments described herein relate to a bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognizes a second antigen, the first antigen is different from the second antigen.

In embodiments, the first antigen and the second antigen do not express on the same cell. In embodiments, the first antigen is an antigen of a blood component, and the second antigen is an antigen of a solid tumor.

Blood cells refer to red blood cells (RBCs), white blood cells (WBCs), platelets, or other blood cells. For example, RBCs are blood cells of delivering oxygen ($O_2$) to the body tissues via the blood flow through the circulatory system. Platelets are cells that are involved in hemostasis, leading to the formation of blood clots. WBCs are cells of the immune system involved in defending the body against both infectious disease and foreign materials. There are a number of different types and sub-types of WBCs and each has a different role to play. For example, granulocytes, monocytes, and lymphocytes are 3 major types of white blood cell. There are three different forms of granulocytes: Neutrophils, Eosinophils, Basophils.

A cell surface molecule of a WBC refers to a molecule expressed on the surface of the WBC. For example, the cell surface molecule of a lymphocyte may include CD19, CD22, CD20, BCMA, CD5, CD7, CD2, CD16, CD56, and CD30. The cell surface molecule of a B cell may include CD19, CD20, CD22, BCMA. The cell surface molecule of a monocyte may include CD14, CD68, CD11b, CD18, CD169, and CD1c. The cell surface molecule of granulocyte may include CD33, CD38, CD138, and CD13.

In embodiments, the first antigen is CD19, and the second antigen is a tumor associated MUC1. In embodiments, the first antigen binding domain comprises one of the amino acid sequences of SEQ ID: 5 and 6. In embodiments, the second antigen binding domain comprises one of the amino acid sequence of SEQ ID: 70-72 and 79-81.

In embodiments, the present disclosure describes a method of enhancing T cell response in a subject or treating a tumor of the subject, the method comprising: administering an effective amount of modified T cell to the subject to provide a T cell response such that the CAR T cell is expanded in the blood of the subject via cells expressing CD19.

In embodiments, the tumor associated MUC1 is expressed on tumor cells, but not on corresponding non-malignant cells. In embodiments, a scFv against the tumor associated MUC1 directly interacts with an o-glycosylated GSTA motif (SEQ ID NO. 88).

Embodiments described herein relate to a cell comprising the bispecific CAR and to an isolated nucleic acid encoding the bispecific CAR.

In embodiments, the present disclosure describes a method of in vivo cell expansion. In embodiments, the method may include administering an effective amount of T cell comprising a CAR to the subject to provide a T cell response; and administering an effective amount of presenting cells (e.g., T cells) expressing a soluble agent that an extracellular domain of the CAR recognizes. In embodiments, the method may be implemented to enhance T cell response in a subject. The method may include administering an effective amount of T cell comprising a CAR to the subject to provide a T cell response and administering an effective amount of presenting cells expressing a soluble agent that an extracellular domain of the CAR recognizes to enhance the T cell response in the subject. In certain embodiments, the presenting cells are T cells, dendritic cells, and/or antigen presenting cells. In certain embodiments, the enhancing T cell response in the subject may include selectively enhancing proliferation of T cell comprising the CAR. In embodiments, the method may be used to enhance treatment of a condition on a subject using CAR T cells. The method may include administering a population of cells that express an agent or administering an agent that is formulated as a vaccine. In these instances, the CAR T cells include a nucleic acid that encodes a CAR, and an extracellular domain of the CAR recognize the agent. In embodiments, the method may be implemented to enhance proliferation of CAR T cells in a subject having a disease. The method may include preparing CAR T cells comprising a CAR; administering an effective amount of the CAR T cells to the subject; introducing, into cells, a nucleic acid encoding an agent that an extracellular domain of the CAR recognizes; and administering an effective amount of the cells (introduced with the nucleic acid encoding the agent) to the subject. In embodiments, the T cell expansion may be measured based on an increase in copy number of CAR molecules in genomic DNA of the T cells. In embodiments, the T cell expansion may be measured based on flow cytometry analysis on molecules expressed on the T cells.

Embodiments described herein relate to an isolated T cell comprising a first CAR and a second CAR, wherein an antigen binding domain of the first CAR binds an antigen such as CD19, CD33, CD14, and BCMA, and an antigen binding domain of the second CAR binds a tumor associated MUC. In embodiments, the tumor associated MUC is MUC1 or MUC2. Embodiments described herein relate to a composition comprising a population of the isolated T cells and to a method of enhancing T cell response in a subject or treating a tumor of the subject, the method comprising: administering an effective amount of the isolated T cell.

In embodiments, the first CAR comprises the amino acid sequence of SEQ ID NO: 207, and the second CAR comprises the amino acid sequence of SEQ ID: 202. In embodiments, the first CAR comprises the amino acid sequence of SEQ ID NO: 203, 207, 216, or 219, and the second CAR comprises the amino acid sequence of SEQ ID: 202 or 205. In embodiments, the antigen binding domain of the second CAR comprises the amino acid sequence of SEQ ID NO: 70. In embodiments, the antigen binding domain of the second CAR comprises the amino acid sequence of SEQ ID NO: 5 or 6. In embodiments, the isolated T cell comprises a nucleic acid sequence of SEQ ID NO: 201, 204, 206, 208, 215, 217, 218, or 220. In embodiments, each of the first CAR and the second CAR comprises an antigen binding domain, a transmembrane domain, and a cytoplasmic domain.

In embodiments, the cytoplasmic domain comprises a co-stimulatory domain and a CD3 zeta domain.

In embodiments, the isolated T cell comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRI), natural killer cell receptor 2B4 (2B4), or CD 160. In embodiments, the isolated T cell comprises a reduced amount of TCR, as compared to the corresponding wide-type T cell. Dominant negative mutations have an altered gene product that acts antagonistically to the wild-type allele. These mutations usually result in an altered molecular function (often inactive) and are characterized by a dominant or semi-dominant phenotype.

The present disclosure describes pharmaceutical compositions. The pharmaceutical compositions include one or more of the following CAR molecules, TCR molecules, modified CAR T cells, modified cells comprising CAR or TCR, modified cells, nucleic acids, and vectors described above. Pharmaceutical compositions are administered in a manner appropriate to the disease to be treated (or prevented). The quantity and frequency of administration will be determined by such factors as the condition of the patient, and the type and severity of the patient's disease, although appropriate dosages may be determined by clinical trials.

When "an immunologically effective amount", "an anti-tumor effective amount", "a tumor-inhibiting effective amount", or "therapeutic amount" is indicated, the precise amount of the compositions of the present disclosure to be administered can be determined by a physician with consideration of individual differences in age, weight, tumor size, extent of infection or metastasis, and condition of the patient (subject). It can be stated that a pharmaceutical composition comprising the T cells described herein may be administered at a dosage of $10^4$ to $10^9$ cells/kg body weight, preferably $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988). The optimal dosage and treatment regime for a particular patient can readily be determined by one skilled in the art of medicine by monitoring the patient for signs of disease and adjusting the treatment accordingly. In certain embodiments, it may be desired to administer activated T cells to a subject and then subsequently redraw the blood (or have apheresis performed), collect the activated and expanded T cells, and reinfuse the patient with these activated and expanded T cells. This process can be carried out multiple times every few weeks. In certain embodiments, T cells can be activated from blood draws of from 10 cc to 400 cc. In certain embodiments, T cells are activated from blood draws of 20 cc, 30 cc, 40 cc, 50 cc, 60 cc, 70 cc, 80 cc, 90 cc, or 100 cc. Not to be bound by theory, using this multiple blood draw/multiple reinfusion protocols, may select out certain populations of T cells.

The administration of the pharmaceutical compositions described herein may be carried out in any convenient manner, including by aerosol inhalation, injection, ingestion, transfusion, implantation, or transplantation. The compositions described herein may be administered to a patient subcutaneously, intradermally, intratumorally, intranodally, intramedullary, intramuscularly, by intravenous (i. v.) injection, or intraperitoneally. In embodiments, the T cell compositions described herein are administered to subjects by intradermal or subcutaneous injection. In embodiments, the T cell compositions of the present disclosure are administered by i.v. injection. The compositions of T cells may be injected directly into a tumor, lymph node, or site of infection. In embodiments, cells activated and expanded using the methods described herein, or other methods known in the art where T cells are expanded to therapeutic levels, are administered to patients in conjunction with (e.g., before, simultaneously or following) any number of relevant treatment modalities, including but not limited to treatment with agents for antiviral therapy, cidofovir and interleukin-2, Cytarabine (also known as ARA-C); or natalizumab treatment for MS patients; or efalizumab treatment for psoriasis patients or other treatments for PML patients. In further embodiments, the T cells described herein can be used in combination with chemotherapy, radiation, immunosuppressive agents, such as cyclosporin, azathioprine, methotrexate, mycophenolate, and FK506, antibodies, or other immunoablative agents such as CAM PATH, anti-CD3 antibodies or other antibody therapies, cytoxin, fludaribine, cyclosporin, FK506, rapamycin, mycophenolic acid, steroids, FR901228, cytokines, and irradiation. These drugs inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun 73:316-321, 1991; Bierer et al., Curr. Opin. Immun 5:763-773, 1993; Isoniemi (supra)). In embodiments, the cell compositions described herein are administered to a subject in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAMPATH. In embodiments, the cell compositions described herein are administered following B-cell ablative therapy. For example, agents that react with CD20, e.g., Rituxan may be administered to patients. In embodiments, subjects may undergo standard treatment with high dose chemotherapy followed by peripheral blood stem cell transplantation. In certain embodiments, following the transplant, subjects receive an infusion of the expanded immune cells of the present disclosure. In embodiments, expanded cells are administered before or following surgery.

The dosage of the above treatments to be administered to a subject in need thereof will vary with the precise nature of the condition being treated and the recipient of the treatment. The scaling of dosages for human administration can be performed according to art-accepted practices by a physician depending on various factors.

Additional information on the methods of cancer treatment using engineered or modified T cells is provided in U.S. Pat. No. 8,906,682, incorporated by reference in its entirety.

Embodiments described herein relate to an in vitro method for preparing modified cells. The method may include obtaining a sample of cells from a subject. For example, the sample may include T cells or T cell progenitors. The method may further include transfecting the sample of cells with a DNA encoding at least a CAR and culturing the population of CAR cells ex vivo in a medium that selectively enhances proliferation of CAR-expressing T cells.

In embodiments, the sample is a cryopreserved sample. In embodiments, the sample of cells is from umbilical cord blood or a peripheral blood sample from the subject. In embodiments, the sample of cells is obtained by apheresis or venipuncture. In embodiments, the sample of cells is a subpopulation of T cells.

The present disclosure is further described by reference to the following exemplary embodiments and examples. These exemplary embodiments and examples are provided for purposes of illustration only and are not intended to be limiting unless otherwise specified. Thus, the present disclosure should in no way be construed as being limited to the following exemplary embodiments and examples, but rather, should be construed to encompass any and all variations which become evident as a result of the teaching provided herein.

Exemplary Embodiments

The following are exemplary embodiments:
1. A nucleic acid encoding a first chimeric antigen receptor (CAR) and a second CAR, wherein a binding domain of the first CAR binds a cell surface molecule of a white blood cell (WBC), and a binding domain of the second CAR binds an antigen different from the cell surface molecule of a WBC.
2. A vector comprising the nucleic acid of embodiment 1.
3. A cell comprising the nucleic acid of embodiment 1.
4. A cell comprising a first CAR and a second CAR, wherein a binding domain of the first CAR binds a cell surface molecule of a cell surface molecule of a WBC, and a binding domain of the second CAR binds an antigen different from the cell surface molecule of a WBC.
5. The cell of any one of embodiments 1-4, wherein the cell is a T cell, NK cell, or dendritic cells.
6. A composition comprising a population of the cells of any one of embodiments 3-5.
7. A method of culturing the cells of any one of embodiments 3-5, the method comprising:
obtaining the cell of any one of embodiments 3-5, wherein a binding domain of the first CAR binds a cell surface molecule of a cell surface molecule of a WBC, and a binding domain of the second CAR binds an antigen different from the cell surface molecule of a WBC; and culturing the cell in the presence of an agent derived from the cell surface molecule of the WBC cell or from an antigen to which a second CAR binds.

8. The method of embodiment 7, wherein the agent is an extracellular domain of the cell surface molecule of the WBC.

9. A method for in vitro CAR cell preparation, the method comprising:
providing cells;
introducing a nucleic acid encoding a first CAR and a second CAR into the cells, wherein a binding domain of the first CAR binds a cell surface molecule of a WBC, and a binding domain of the second CAR binds an antigen different from the cell surface molecule of the WBC; and
culturing the cells in the presence of an agent derived from the cell surface molecule of the WBC or from an antigen to which the second CAR binds.

10. A method of enhancing T cell response in a subject or treating a tumor of the subject, the method comprising:
administering an effective amount of T cell comprising a first CAR and a second CAR to the subject to provide a T cell response, wherein a binding domain of the first CAR binds a cell surface molecule of a WBC, and a binding domain of the second CAR binds an antigen different from the cell surface molecule of the WBC.

11. The method of embodiment 10, wherein enhancing the T cell response in the subject comprises selectively enhancing proliferation of T cell comprising the first and second CARs in vivo.

12. A method of expanding cells expressing CAR in vivo, the method comprising:
administering an effective amount of T cell comprising a first CAR and a second CAR to the subject, wherein a binding domain of the first CAR binds a cell surface molecule of a WBC, and
a binding domain of the second CAR binds an antigen different from the cell surface molecule of the WBC, the cells being T cells, NK cells, or dendritic cells.

13. The nucleic acid, the vector, the cell, the composition, or the method of any one of embodiments 1-12, wherein the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Ra2 (zetakine), Kappa, Leukemia, LewisY, Mesothelin, MUC1, NKG2D, NY-ESO-1, PSMA, ROR-1, TRAIL-receptor1, or VEGFR2.

14. The nucleic acid, the vector, the cell, the composition, or the method of embodiment 13, wherein the MUC1 is a tumor-exclusive epitope of a human MUC1, and the first CAR and the second CAR are expressed as separate polypeptides.

15. The nucleic acid, the vector, the cell, the composition, or the method of embodiment 13, wherein the MUC1 is a tumor form of human MUC1 (tMUC1).

16. The nucleic acid, the vector, the cell, the composition, or the method of any one of embodiments 1-12, wherein the WBC is a granulocyte, a monocyte, or lymphocyte.

17. The nucleic acid, the vector, the cell, the composition, or the method of any one of embodiments 1-12, wherein the WBC is a B cell.

18. The nucleic acid, the vector, the cell, the composition, or the method of any one of embodiments 1-12, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

19. The nucleic acid, the vector, the cell, the composition, or the method of any one of embodiments 1-12, wherein the cell surface molecule of the WBC is CD19, CD20, CD22, or BCMA.

20. The nucleic acid, the vector, the cell, the composition, or the method of any one of embodiments 1-12, wherein the cell surface molecule of the WBC is CD19.

21. The nucleic acid, the vector, the cell, the composition, or the method of any one of embodiments 1-12, wherein the first CAR comprises the first antigen binding domain, a transmembrane domain, a co-stimulatory domain, and a CD3 zeta domain; and/or the second CAR comprises the second antigen binding domain, a transmembrane domain, a co-stimulatory domain, and a CD3 zeta domain.

22. The nucleic acid, the vector, the cell, the composition, or the method of any one of embodiments 1-12, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

23. The nucleic acid, the vector, the cell, the composition, or the method of any one of embodiments 1-12, wherein the antigen binding domain is a Fab or a scFv.

24. The nucleic acid, the vector, the cell, the composition, or the method of any one of embodiments 1-12, wherein the first CAR comprises the amino acid sequence of SEQ ID NO: 5, 6, 53 and 54, 55 and 56, or 57 and 58, and the second CAR comprises the amino acid sequence of SEQ ID NO: 5-17, 29, 33, 37, 71, or 72, or the amino acid sequence encoded by nucleic acid sequence SEQ ID NO: 41, 45, 63, 67, or 68.

25. The nucleic acid, the vector, the cell, the composition, or the method of any one of embodiments 1-12, wherein a nucleic acid encoding the first CAR comprises the nucleic acid sequence of SEQ ID NO: 59, or 60, and a nucleic acid sequence encoding the second CAR comprises the nucleic acid sequence of SEQ ID NO: 61.

26. The nucleic acid, the vector, the cell, the composition, or the method of any one of embodiments 1-12, wherein the nucleic acid comprises one of the nucleic acid sequences of SEQ ID NO: 62-69.

27. The nucleic acid, the vector, the cell, the composition, or the method of any one of embodiments 1-12, wherein the first CAR and the second CAR are expressed as separate polypeptides.

28. A modified T cell comprising a first CAR and a second CAR, wherein a binding domain of the first CAR binds CD19, and a binding domain of the second CAR binds tumor associated MUC1.

29. The modified T cell of embodiment 28, wherein the binding domain of the second CAR comprises:
(i) a heavy chain complementary determining region 1 comprising the amino acid sequence of SEQ ID: 76 or 85, a heavy chain complementary determining region 2 comprising the amino acid sequence of SEQ ID: 77 or 86, and a heavy chain complementary determining region 3 comprising the amino acid sequence of SEQ ID: 78 or 87; and
(ii) a light chain complementary determining region 1 comprising the amino acid sequence of SEQ ID: 73 or 82, a light chain complementary determining region 2 comprising the amino acid sequence of TRP-ALA-SER (WAS) or SEQ ID: 83, and a light chain complementary determining region 3 comprising the amino acid sequence of SEQ ID: 75 or 84.
30. The modified T cell of embodiment 28, wherein the binding domain of the second CAR comprises:
(i) a heavy chain complementary determining region 1 comprising the amino acid sequence of SEQ ID: 76, a heavy chain complementary determining region 2 comprising the amino acid sequence of SEQ ID: 77, and a heavy chain complementary determining region 3 comprising the amino acid sequence of SEQ ID: 78; and (ii) a light chain complementary determining region 1 comprising the amino acid sequence of SEQ ID: 73, a light chain complementary determining region 2 comprising the amino acid sequence of TRP-ALA-SER (WAS), and a light chain complementary determining region 3 comprising the amino acid sequence of SEQ ID: 75.
31. The modified T cell of embodiment 28, wherein the binding domain of the second CAR comprises: (i) a heavy chain complementary determining region 1 comprising the amino acid sequence of SEQ ID: 85, a heavy chain complementary determining region 2 comprising the amino acid sequence of SEQ ID: 86, and a heavy chain complementary determining region 3 comprising the amino acid sequence of SEQ ID: 87; and (ii) a light chain complementary determining region 1 comprising the amino acid sequence of SEQ ID: 82, a light chain complementary determining region 2 comprising the amino acid sequence of SEQ ID: 83, and a light chain complementary determining region 3 comprising the amino acid sequence of SEQ ID: 84.
32. The modified T cell of embodiment 28, wherein the binding domain of the first CAR comprises the amino acid sequence of SEQ ID: 5 or 6.
33. The modified T cell of embodiment 28, wherein the binding domain of the second CAR comprises one of the amino acid sequences of SEQ ID: 70-72 and 79-81.
34. The modified T cell of any one of embodiments 28-33, wherein the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.
35. The modified T cell of embodiment 34, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.
36. The modified T cell of any one of embodiments 28-35, wherein the first CAR and the second CAR are expressed as gene products that are separate polypeptides.
37. The modified T cell of any one of embodiments 28-35, wherein the cytoplasmic domain or the transmembrane domain of the second CAR is modified such that the second CAR is capable of activating the modified T cell via cells expressing CD19 without damaging the cells expressing CD19.
38. A bispecific CAR, comprising:
a first antigen binding domain, a second antigen binding domain, a cytoplasmic domain, and a transmembrane domain, wherein the first antigen binding domain recognizes a first antigen, the second antigen binding domain recognize a second antigen, and the first antigen is different from the second antigen.
39. The bispecific CAR of embodiment 38, wherein the first antigen and the second antigen are not expressed on the same cell.
40. The bispecific CAR of embodiment 38, wherein the first antigen is an antigen of a blood component, and the second antigen is an antigen of a solid tumor.
41. The bispecific CAR of embodiment 38, wherein the first antigen is CD19, and the second antigen is a tumor associated MUC1.
42. The bispecific CAR of embodiment 38, wherein the first antigen binding domain comprises amino acid sequence of SEQ ID: 5 or 6.
43. The modified T cell of embodiment 28, wherein the second antigen binding domain comprises one of the amino acid sequences of SEQ ID: 70-72 and 79-81.
44. A method of enhancing T cell response in a subject or treating a tumor of the subject, the method comprising: administering an effective amount of the modified T cell of any one of embodiments 28-37 to the subject to provide a T-cell response such that the modified T cell is expanded in the blood of the subject via cells expressing CD19.
45. The modified T cell of any one of embodiments 28-37, wherein the tumor associated MUC1 is expressed on tumor cells and not on corresponding non-malignant cells.
46. The modified T cells of any one of embodiments 28-37, wherein the binding domain of the second CAR comprises a scFv against the tumor associated MUC1 that directly interacts with an o-glycosylated GSTA motif (SEQ ID NO. 88).
47. A cell comprising the bispecific CAR of any one of embodiments 38-43.
48. A nucleic acid encoding the bispecific CAR of any one of embodiments 38-43.
49. A nucleic acid encoding a first CAR and a second CAR, wherein a binding domain of the first CAR binds an antigen selected from the group consisting of CD19, CD33, CD14, and BCMA, and a binding domain of the second CAR binds a tumor associated MUC1.
50. A T cell comprising a first CAR and a second CAR, wherein a binding domain of the first CAR binds an antigen selected from the group consisting of CD19, CD33, CD14, and BCMA, a binding domain of the second CAR binds a tumor associated MUC1.
51. A T cell comprising a first nucleic acid encoding a first CAR and a second nucleic acid encoding a second CAR, wherein a binding domain of the first CAR binds an antigen selected from the group consisting of CD19, CD33, CD14, and BCMA, a binding domain of the second CAR binds a tumor associated MUC1.
52. A composition comprising a population of the T cells of embodiment 50 or 51.
53. The T cell of embodiment 50 or 51, wherein the first CAR and the second CAR are expressed as separate polypeptides.
54. The nucleic acid of embodiment 1 or the T cell of embodiment 50 or 51, wherein the nucleic acid comprises one of the nucleic acid sequences of SEQ ID NO: 201, 204, 206, 208, 209, 211, 213-215, 217, 218, 220-225, 227, 228, 230-235, 237, 238, 240-244, 247, 249-254, 256, 257, 259, and 260-263.
55 The nucleic acid of embodiment 49 or the T cell of embodiment 50 or 51, wherein the nucleic acid comprises one of the nucleic acid sequences of SEQ ID NO: 201, 204, 206, 208, 215, 217, 218, and 220.

56. The nucleic acid of embodiment 49 or the cell of embodiment 50 or 51, wherein the first CAR comprises the amino acid sequence of SEQ ID NO: 203, 207, 216, 219, 226, 229, 236, 239, 245, 248, 255, or 258, and the second CAR comprises the amino acid sequence of SEQ ID: 202, 205, 210, or 212.

57. The nucleic acid of embodiment 49 or the cell of embodiment 50 or 51, wherein the first CAR comprises the amino acid sequence of SEQ ID NO: 207, and the second CAR comprises the amino acid sequence of SEQ ID NO: 202.

58. The nucleic acid of embodiment 49 or the cell of embodiment 50 or 51, wherein the first CAR comprises the amino acid sequence of SEQ ID NO: 203, 207, 216, or 219, and the second CAR comprises the amino acid sequence of SEQ ID NO: 202 or 205.

59. A vector comprising the nucleic acid of embodiment 49.

60. A cell comprising the nucleic acid of embodiment 49.

61. A composition comprising a population of the cells of embodiment 60.

62. The cell of embodiments 60 or 61, wherein the cell is a T cell, NK cell, or dendritic cells.

63. A genetically modified T cell comprising one or more nucleic acids encoding a CAR and one or more TCR chains or a TCR of an innate T cell.

64. The genetically modified T cell of embodiment 63, wherein the nucleic acid encoding the one or more TCR chains or a TCR of an innate T cell is a nucleic acid insert within a target genomic locus.

65. The genetically modified T cell of embodiment 63, wherein integration of the nucleic acid insert causes replacement of at least of a portion of a gene at the target genomic locus.

66. The genetically modified T cell of embodiment 63, wherein the nucleic acid is introduced into the T cell using a nuclease agent.

67. A method of modifying a target genomic locus in a T cell, the method comprising: introducing into the T cell a nuclease agent that makes a single or double-strand break within the target genomic locus; and introducing into the T cell a nucleic acid insert comprising a nucleic acid encoding one or more TCR chains or a TCR of an innate T cell; and selecting the T cell comprising the nucleic acid insert integrated into the target genomic locus.

68. The method of embodiment 67, wherein the nucleic acid insert is flanked by a 5' homology arm and a 3' homology arm, and the 3' homology arm of the nucleic acid insert and the 5' homology arm of the nucleic acid insert are homologous to corresponding genomic segments within the target genomic locus.

69. The method of embodiment 67, wherein the target genomic locus is modified by integration of the nucleic acid insert between the corresponding genomic segments.

70. The method of embodiment 67, wherein the nuclease agent is a zinc finger nuclease (ZFN), a Transcription Activator-Like Effector Nuclease (TALEN), or a meganuclease.

71. The method of embodiment 67, wherein the nuclease agent comprises a Clustered Regularly Interspaced Short Palindromic Repeats (CRISPR)-associated (Cas) protein and a guide RNA (gRNA).

72. The method of embodiment 71, wherein the Cas protein is Cas9.

73. The genetically modified T cell or the method of any one of embodiments 63-72, wherein the innate T cell comprises a γδ T cell, an iNKT cell, or a MAIT cell.

74. The genetically modified T cell or the method of any one of embodiments 63-72, wherein the innate T cell comprises a γδ T cell.

75. The genetically modified T cell or the method of any one of embodiments 63-72, wherein the innate T cell comprises a Vγ9Vδ2 T cell.

76. The genetically modified T cell or the method of embodiment 75, wherein the one or more nucleic acids encoding one or more TCR chains encodes a TCR γ chain and a TCR δ chain.

77. The genetically modified T cell or the method of embodiment 75, wherein the one or more nucleic acids encoding one or more TCR chains encodes an endogenous TCR γ chain and an endogenous TCR δ chain.

78. The genetically modified T cell or the method of embodiment 75, wherein the nucleic acid insert comprises a nucleic acid that corresponds to one or more the amino acid sequences of SEQ ID No.: 99 and 185, or a combination thereof.

79. The genetically modified T cell or the method of any one of embodiments 63-72, wherein the innate T cell comprises an iNKT cell.

80. The genetically modified T cell or the method of embodiment 79, wherein the nucleic acid encoding the TCR of an innate T cell encodes an iNKT α chain and/or an iNKT β chain.

81. The genetically modified T cell or the method of embodiment 79, wherein the nucleic acid encoding the TCR of an innate T cell encodes an endogenous iNKT α chain or an endogenous iNKT β chain.

82. The genetically modified T cell or the method of any one of embodiments 63-72, wherein the innate T cell comprises a MAIT cell.

83. The genetically modified T cell or the method of embodiment 82, wherein the nucleic acid encoding the TCR of an innate T cell encodes a MAIT α chain and/or a MAIT β chain.

84. The genetically modified T cell or the method of embodiment 82, wherein the nucleic acid encoding the TCR of an innate T cell encodes an endogenous MAIT α chain or an endogenous MAIT β chain.

85. The genetically modified T cell or the method of any one of embodiments 63-84, wherein the target genomic locus is α or β TCR gene locus of an αβ T cell.

86. The genetically modified T cell or the method of any one of embodiments 63-84, wherein the integration of the nucleic acid insert causes replacement a sequence at α or β TCR gene locus of an αβ T cell such that expression of overall endogenous TCR is not reduced.

87. The genetically modified T cell or the method of any one of embodiments 63-84, wherein corresponding genomic segments of the target genomic locus comprise the amino acid sequence of a chain of TCR.

88. The genetically modified T cell or the method of any one of embodiments 63-84, wherein the genetically modified cell elicits a reduced graft versus host disease response against allogeneic cells as compared to a corresponding cell that does not include nucleic acid sequence.

89. The genetically modified T cell or the method of any one of embodiments 63-84, wherein the T cell is a T cell derived from a primary human T cell isolated from a human donor.

90. The genetically modified T cell or the method of any one of embodiments 63-84, wherein the T cell comprises a CAR.

91. The genetically modified cell or the method of any one of embodiments 63-90, wherein the genetically modified cell has functional TCRs comprising the one or more TCR chains.
92. The genetically modified cell or the method of any one of embodiments 63-90, wherein the TCR of the innate T cells and αβ TCR originate from the donor.
93. The genetically modified cell or the method of any one of embodiments 63-92, wherein the innate T cell exhibits a non-MHC class I or II restriction requirement for antigen recognition.
94. A method of causing a T-cell response in a subject or treating a tumor of the subject, the method comprising: administering an effective amount of the T cell of any one of embodiments 63-92.
95. A nucleic acid encoding a binding molecule comprising a first domain and a second binding domain, wherein the first binding domain and the second binding domain bind to an antigen.
96. The nucleic acid of embodiment 95, wherein one or more targeting antigen binding sites of the first binding domain and the second binding domain are different, and the binding molecule is a CAR comprising the first binding domain, a linker, the second binding domain, a transmembrane domain, and a co-stimulatory domain and/or a CD3 zeta domain.
97. The nucleic acid of embodiment 95, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Ra2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Mucin 17 (MUC17), GUCY2C, CD207, CD3, CD5, B-Cell Maturation Antigen (BCMA), or CD4.
98. The nucleic acid of embodiment 95, wherein the first binding domain binds tumor associated Muc1, TSHR, FZD10, PRLR, Mucin 16 (MUC16), MUC17, GUCY2C, CD207, CLDN18.2, CLDN6, or SIGL1C.
99. The nucleic acid of embodiment 95, wherein the nucleic acid encodes a polypeptide comprising one of the amino acid sequences of SEQ ID NO: 264 and 265.
100. A vector comprising a nucleic acid of any one of embodiments 95-99.
101. A host cell transformed or transfected with the nucleic acid of any one of embodiments 95-99 or with the vector of embodiment 100.
102. A method for the production of a binding molecule encoded by the nucleic acid of any one of embodiments 95-99, the method comprising culturing a host cell of embodiment 101 under conditions allowing expression of the binding molecule of any one of embodiments 95-99 and recovering the binding molecule from the culture.
103. A pharmaceutical composition comprising a binding molecule encoded by the nucleic acid of any one of embodiments 95-99 or produced according to the method of embodiment 102.
104. A kit comprising a binding molecule encoded by the nucleic acid of any one of embodiments 95-99, a nucleic acid of any one of embodiments 95-99, a vector of embodiment 100, and/or a host cell of embodiment 101.
105. A method for the treatment or amelioration of a disease, comprising administering to a subject in need thereof the binding molecule encoded by the nucleic acid of any one of embodiments 95-99.
106. A nucleic acid encoding a first antigen binding molecule and a second antigen binding molecule, wherein a binding domain of the first antigen binding molecule binds a cell surface molecule of a WBC, and a binding domain of the second antigen binding molecule binds a solid tumor antigen that is different from the cell surface molecule of the WBC.
107. A vector comprising the nucleic acid of embodiment 106.
108. A cell comprising the nucleic acid of embodiment 106.
109. A cell comprising a first antigen binding molecule and a second antigen binding molecule, wherein a binding domain of the first antigen binding molecule binds a cell surface molecule of a WBC, and a binding domain of the second antigen binding molecule binds a solid tumor antigen that is different from the cell surface molecule of a WBC.
110. A composition comprising a population of the cell of any one of embodiments 108-109.
111. The cell of any one of embodiments 108-109, wherein the cell is a T cell, NK cell, or dendritic cells.
112. A method of culturing cells, the method comprising: obtaining a cell comprising a first antigen binding molecule and a second antigen binding molecule, wherein a binding domain of the first antigen binding molecule binds a cell surface molecule of a WBC, and a binding domain of the second antigen binding molecule binds a solid tumor antigen that is different from the cell surface molecule of the WBC; and culturing the cell in the presence of an agent derived from the cell surface molecule of the WBC or from an antigen to which the second antigen binding molecule binds.
113. The method of embodiment 112, wherein the agent is an extracellular domain of the cell surface molecule of the WBC.
114. A method for in vitro cell preparation, the method comprising: preparing cells; introducing a nucleic acid encoding a first antigen binding molecule and a second antigen binding molecule into the cells, a binding domain of the first antigen binding molecule binding to a cell surface molecule of a WBC, and a binding domain of the second antigen binding molecule binding to an antigen different from the cell surface molecule of the WBC; and culturing the cells in the presence of an agent derived from the cell surface molecule of the WBC or from an antigen to which the second antigen binding molecule binds.
115. A method of enhancing T cell response in a subject or treating a tumor of the subject, the method comprising: administering an effective amount of T cell comprising a first antigen binding molecule and a second antigen binding molecule to the subject to provide a T cell response, wherein a binding domain of the first antigen binding molecule binds a cell surface molecule of a WBC, and a binding domain of the second antigen binding molecule binds an antigen different from the cell surface molecule of the WBC.
116. The method of embodiment 115, wherein enhancing T cell response in the subject comprises selectively enhancing proliferation of T cell comprising the first antigen binding molecule and the second antigen binding molecule in vivo.

117. A method of expanding cells expressing an antigen binding molecule in vivo, the method comprising: administering an effective amount of T cell comprising a first antigen binding molecule and a second antigen binding molecule to the subject, wherein a binding domain of the first antigen binding molecule binds a cell surface molecule of a WBC, and a binding domain of the second antigen binding molecule binds a solid tumor antigen that is different from the cell surface molecule of the WBC, the cells being T cells, NK cells, or dendritic cells.

118. The nucleic acid, the vector, the cell, or the method of any one of embodiments 106-117, wherein the first antigen binding molecule is a first chimeric antigen receptor (CAR) and the second antigen binding molecule is a second CAR.

119. The nucleic acid, the vector, the cell, or the method of embodiment 118, wherein the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Ra2 (zetakine), Kappa, Leukemia, LewisY, Mesothelin, MUC1, NKG2D, NY-ESO-1, PSMA, ROR-1, TRAIL-receptor1, or VEGFR2.

120. The nucleic acid, the vector, the cell, or the method of embodiment 118, wherein the MUC1 is a tumor-exclusive epitope of a human MUC1, and the first CAR and the second CAR are expressed as polypeptides.

121. The nucleic acid, the vector, the cell, or the method of embodiment 118, wherein the MUC1 is a tumor form of human MUC1 (tMUC1).

122. The nucleic acid, the vector, the cell, or the method of embodiment 118, wherein the WBC is a granulocyte, a monocyte and or lymphocyte.

123. The nucleic acid, the vector, the cell, or the method of embodiment 118, wherein the WBC is a B cell.

124. The nucleic acid, the vector, the cell, or the method of embodiment 118, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13, or the cell surface molecule of the WBC is CD19, CD20, CD22, or BCMA.

125. The nucleic acid, the vector, the cell, or the method of embodiment 118, wherein the cell surface molecule of the WBC is CD19.

126. The nucleic acid, the vector, the cell, or the method of embodiment 118, wherein the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

127. The nucleic acid, the cell, or the method of embodiment 110, wherein the co-stimulatory domain comprises the intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

128. The nucleic acid, the vector, the cell, or the method of embodiment 118, wherein the antigen binding domain is a Fab or a scFv.

129. The nucleic acid, the vector, the cell, or the method of embodiment 118, wherein the first CAR comprises the amino acid sequence of SEQ ID NO: 5, 6, 53 and 54, 55 and 56, or 57 and 58, and the second CAR comprises the amino acid sequence of one of SEQ ID NOs: 5-17, 29, 33, 37, 71, and 72, or the amino acid sequence encoded by the nucleic acid of SEQ ID NO: 41, 45, 63, 67, or 68.

130. The nucleic acid, the vector, the cell, or the method of embodiment 118, wherein a nucleic acid encoding the first CAR comprises the nucleic acid sequence of SEQ ID NO: 59, or 60, and a nucleic acid encoding the second CAR comprises the nucleic acid sequence of SEQ ID NO: 61.

131. The nucleic acid, the vector, the cell, or the method of embodiment 118, wherein the nucleic acid comprises one of the nucleic acid sequence of SEQ ID NO: 62-69.

132. The nucleic acid, the vector, the cell, or the method of embodiment 118, wherein the first CAR and the second CAR are expressed as gene products that are separate polypeptides.

133. The nucleic acid, the vector, the cell, or the method of any one of embodiments 106-132, wherein the first antigen binding molecule is a chimeric antigen receptor (CAR) and the second antigen binding molecule is a T Cell Receptor (TCR).

134. The nucleic acid, the vector, the cell, or the method of embodiment 133, wherein the TCR is modified TCR.

135. The nucleic acid, the vector, the cell, or the method of embodiment 133, wherein the TCR is derived from spontaneously occurring tumor-specific T cells in patients.

136. The nucleic acid, the cell, or the method of embodiment 133, wherein the TCR binds a tumor antigen.

137. The nucleic acid, the vector, the cell, or the method of embodiment 133, wherein the tumor antigen comprises CEA, gp100, MART-1, p53, MAGE-A3, or NY-ESO-1, or the TCR comprises TCRγ and TORδ Chains or TCRα and TCRβ chains, or a combination thereof.

138. A modified T cell comprising a first CAR and a second CAR, wherein a binding domain of the first CAR binds CD19, and a binding domain of the second CAR binds tumor associated MUC1.

139. The modified T cell of embodiment 138, wherein the binding domain of the second CAR comprises: (i) a heavy chain complementary determining region 1 comprising the amino acid sequence of SEQ ID: 76 or 85, a heavy chain complementary determining region 2 comprising the amino acid sequence of SEQ ID: 77 or 86, and a heavy chain complementary determining region 3 comprising the amino acid sequence of SEQ ID: 78 or 87; and (ii) a light chain complementary determining region 1 comprising the amino acid sequence of SEQ ID: 73 or 82, a light chain complementary determining region 2 comprising the amino acid sequence of TRP-ALA-SER (WAS) or SEQ ID: 83, and a light chain complementary determining region 3 comprising the amino acid sequence of SEQ ID: 75 or 84.

140. The modified T cell of embodiment 138, wherein the binding domain of the second CAR comprises: (i) a heavy chain complementary determining region 1 comprising the amino acid sequence of SEQ ID: 76, a heavy chain complementary determining region 2 comprising the amino acid sequence of SEQ ID: 77, and a heavy chain complementary determining region 3 comprising the amino acid sequence of SEQ ID: 78; and (ii) a light chain complementary determining region 1 comprising the amino acid sequence of SEQ ID: 73, a light chain complementary determining region 2 comprising the amino acid sequence of TRP-ALA-SER (WAS), and a light chain complementary determining region 3 comprising the amino acid sequence of SEQ ID: 75.

141. The modified T cell of embodiment 138, wherein the binding domain of the second CAR comprises: (i) a heavy chain complementary determining region 1 comprising the amino acid sequence of SEQ ID: 85, a heavy chain complementary determining region 2 comprising the amino acid sequence of SEQ ID: 86, and a heavy chain complementary determining region 3 comprising the amino acid sequence of SEQ ID: 87; and (ii) a light chain complementary determining region 1 comprising the amino acid sequence of SEQ ID: 82, a light chain complementary determining region 2 comprising the amino acid sequence of SEQ ID: 83, and a light chain complementary determining region 3 comprising the amino acid sequence of SEQ ID: 84.

142. The modified T cell of embodiment 138, wherein the binding domain of the first CAR comprises the amino acid sequence of SEQ ID: 5 or 6.

143. The modified T cell of embodiment 138, wherein the binding domain of the second CAR comprises one of the amino acid sequences of SEQ ID: 70-72 and 79-81.

144. The modified T cell of any one of embodiments 138-143, wherein the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

145. The modified T cell of embodiment 144, wherein the co-stimulatory domain comprises the intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

146. The modified T cell of any one of embodiments 138-145, wherein the first CAR and the second CAR are expressed as gene products that are separate polypeptides.

147. The modified T cell of any one of embodiments 138-146, wherein the cytoplasmic domain or the transmembrane domain of the second CAR is modified such that the second CAR is capable of activating the modified T cell via cells expressing CD19 without damaging the cells expressing CD19.

148. A bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognize a second antigen, the first antigen is different from the second antigen.

149. The bispecific chimeric antigen receptor of embodiment 148, wherein the first antigen and the second antigen are not expressed on the same cell.

150. The bispecific chimeric antigen receptor of embodiment 148 or 149, wherein the first antigen is an antigen of a blood component, and the second antigen is an antigen of a solid tumor.

151. The bispecific chimeric antigen receptor of any one of embodiments 148-150, wherein the first antigen is CD19, and the second antigen is a tumor associated MUC1.

152. The bispecific chimeric antigen receptor of any one of embodiments 148-151, wherein the first antigen binding domain comprises one of the amino acid sequences of SEQ ID: 5 and 6.

153. The modified T cell of any one of embodiments 138-147, wherein the second antigen binding domain comprises one of the amino acid sequence of SEQ ID: 70-72 and 79-81.

154. A method of enhancing T cell response in a subject or treating a tumor of the subject, the method comprising: administering an effective amount of modified T cell of any one of embodiments 138-147 to the subject to provide a T-cell response such that the CAR T cell is expanded in the blood of the subject via cells expressing CD19.

155. The modified T cells of any one of embodiments 138-147, wherein the tumor associated MUC1 are expressed on tumor cells and not on corresponding non-malignant cells.

156. The modified T cells of any one of embodiments 138-147, wherein a scFv against the tumor associated MUC1 directly interacts with an o-glycosylated GSTA motif (SEQ ID NO. 88).

157. A cell comprising the bispecific CAR of any one of embodiments 148-152.

158. A nucleic acid encoding the bispecific CAR of any one of embodiments 148-152.

159. A T cell comprising a first CAR and a second CAR, wherein an antigen binding domain of the first CAR binds an antigen selected from the group consisting of CD19, CD33, CD14, and BCMA, and an antigen binding domain of the second CAR binds a tumor associated MUC1.

160. The T cell of embodiment 159, wherein the first CAR comprises the amino acid sequence of SEQ ID NO: 207, and the second CAR comprises the amino acid sequence of SEQ ID: 202.

161. The T cell of embodiment 159, wherein the first CAR comprises the amino acid sequence of SEQ ID NO: 203, 207, 216, or 219, and the second CAR comprises the amino acid sequence of SEQ ID: 202 or 205.

162. The T cell of embodiment 159, wherein the antigen binding domain of the second CAR comprises the amino acid sequence of SEQ ID NO: 70.

163. The T cell of embodiment 159, wherein the antigen binding domain of the second CAR comprises the amino acid sequence of SEQ ID NO: 5 or 6.

164. The T cell of embodiment 159, wherein the Isolated T cell comprises one of the nucleic acid sequences of SEQ ID NO: 201, 204, 206, 208, 215, 217, 218, and 220.

165. The T cell of any one of embodiments 159-164, wherein each of the first CAR and the second CAR comprises an antigen binding domain, a transmembrane domain, and a cytoplasmic domain.

166. The T cell of embodiment 165, wherein the cytoplasmic domain comprises a co-stimulatory domain and a CD3 zeta domain.

167. The T cell of embodiment 166, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

168. The T cell of embodiment 159, wherein the T cell comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIR1), natural killer cell receptor 2B4 (2B4), or CD 160.
169. The T cell of embodiment 159, wherein the T cell comprises a reduced amount of TCR, as compared to the corresponding wide-type T cell.
170. A composition comprising a population of the T cell of any one of embodiments 159-169.
171. A method of enhancing T cell response in a subject or treating a tumor of the subject, the method comprising: administering an effective amount of the T cell of any one of embodiments 159-169.
172. The nucleic acid, the vector, the cell (including T cell and modified T cell), the bispecific CAR, the composition, or the method of any one of embodiments 1-171, wherein the tumor antigen, is a solid tumor antigen.
173. The nucleic acid, the vector, the cell (including T cell and modified T cell), the bispecific CAR, the composition, or the method of any one of embodiments 1-172, wherein the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, or EGFR, and the B cell antigen is CD19, CD20, CD22, or BCMA.

EXAMPLES

Example 1. Expression of CARs on T Cells

Lentiviral vectors that encode a CD19 CAR (CAR: SEQ ID NO. 207 and scFv: SEQ ID NO. 6) and tumor associated MUC1 CAR (CAR: SEQ ID NO. 202 and scFv: SEQ ID NO. 70) were generated, as shown in FIG. 1 (see "Chimeric Receptors Containing CD137 Signal Transduction Domains Mediate Enhanced Survival of T Cells and Increased Anti-leukemic Efficacy In Vivo," Molecular Therapy, August 2009, vol. 17 no. 8, 1453-1464 incorporated herein by reference in its entirety).

Figure 6:
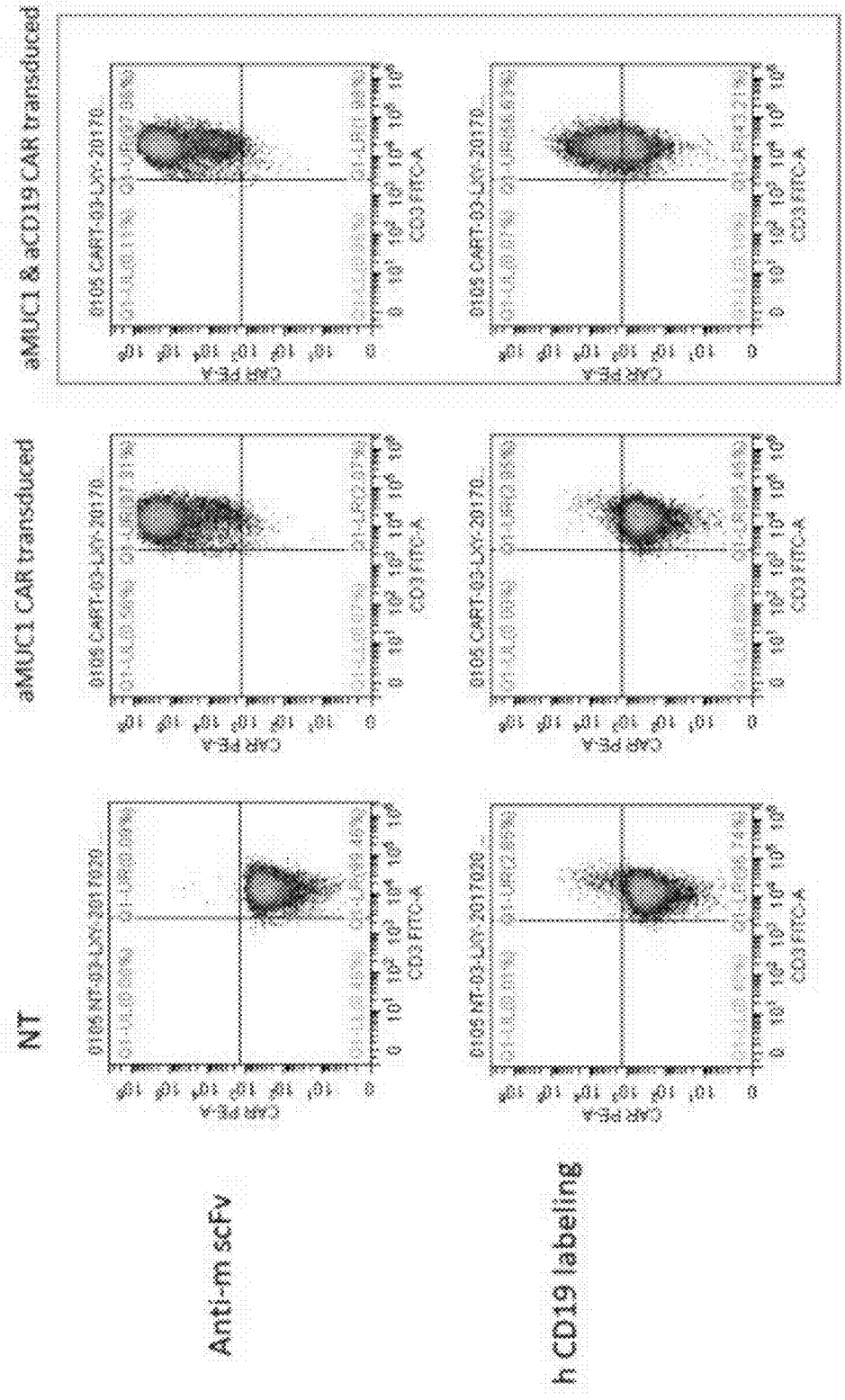
FIG. 6 displays flow cytometry results showing T cells expressing anti-CD19 CAR and anti-MUC1 CAR.

Primary T cells were obtained from patients. The obtained primary T cells were transduced with lentiviral vectors to obtain modified T cells. Flow-cytometry was performed and analyzed to confirm the expression of CARs in primary T cells (See FIG. 6). Techniques related to cell cultures, construction of lentiviral vectors, and flow cytometry may be found in "Control of large, established tumor xenografts with genetically retargeted human T cells containing CD28 and CD137 domains," PNAS, Mar. 3, 2009, vol. 106 no. 9, 3360-3365, which is incorporated herein by reference in its entirety.

Example 2. IFN-γ Release in Co-Cultivation Assays

Figure 7:
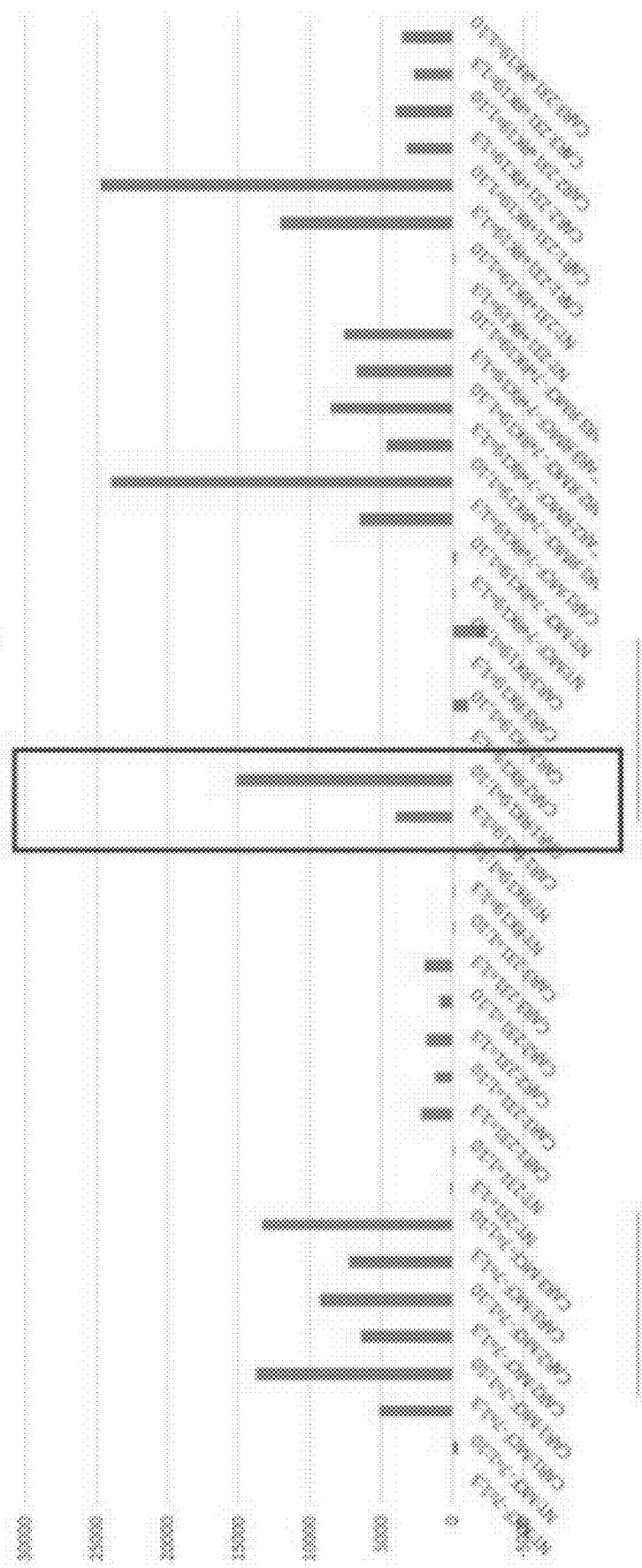
FIG. 7 shows functional analysis of T cells expressing anti-CD19 CAR and anti-MUC1 CAR.

T cells were transfected with the lentiviral vectors encoding dual CARs (CD19 and TA-MUC1 CARs, see dual CARs in FIGS. 8 and 9) and lentiviral vectors encoding single CAR (TA-MUC1 CAR, see 5E5 CAR in FIGS. 8 and 9), respectively. Two types of T cells and different single type or multiple types of substrate cells were co-cultured and the release of IFN-γ was observed. Substrate cells include MUC1-positive tumor cells (MCF-7), MUC1-negative tumor cells (231), and CD19-positive tumor cells (RK19). A ratio of E:T (Effector Cell:Target Cell) 1:1/3:1/10:1/30:1 (i.e., CAR T cells: target tumor cells) of CAR T cells and target tumor cells were co-cultured for 24 hours. Subsequently, the supernatant was collected, and release of IFN-γ was measured. Various levels of IFN-γ release were observed when CAR T cells and the substrate cells were co-cultured (See FIG. 7). As further shown in FIGS. 8 and 9, dual CAR T cells released IFN-γ in response to co-culturing with CD19-positive tumor cells and MUC1-positive tumor cells, while single CAR T cells released little IFN-γ in response to co-culturing with CD19-positive tumor cells. Further, in response to co-culturing with CD19-positive tumor cells and MUC1-positive tumor cells, dual CAR T cells released a greater amount of IFN-γ as compared to single CAR T cells. Techniques related to cell cultures, construction of cytotoxic T-lymphocyte assay may be found in "Control of large, established tumor xenografts with genetically retargeted human T cells containing CD28 and CD137 domains," PNAS, Mar. 3, 2009, vol. 106 no. 9, 3360-3365, which is incorporated herein by reference in its entirety.

Example 3. Expression of CAR/Antigen on Primary T Cells

Figure 8:
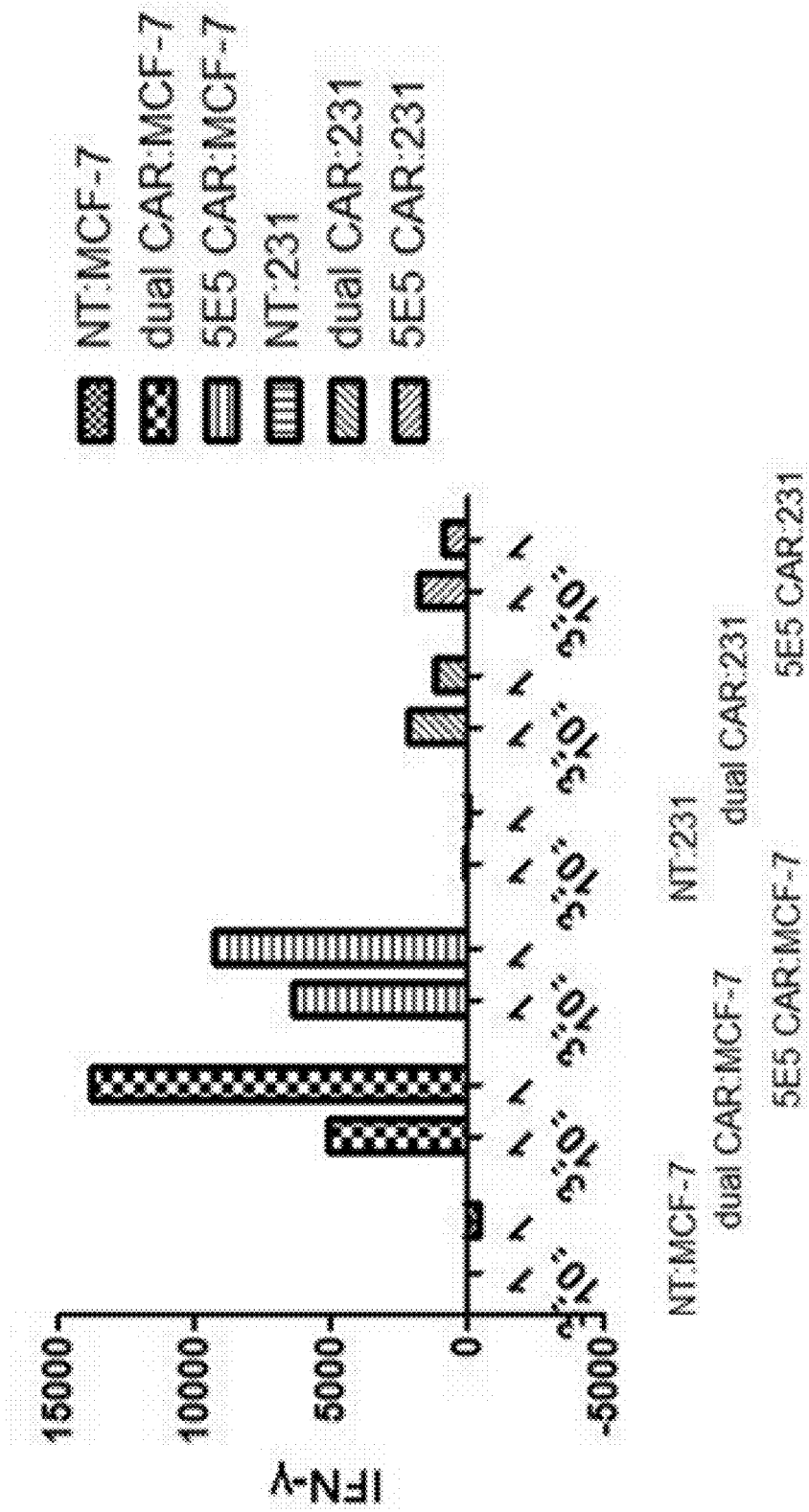
FIG. 8 displays a histogram showing T cell response to co-culturing with various substrate cells.
Figure 9:
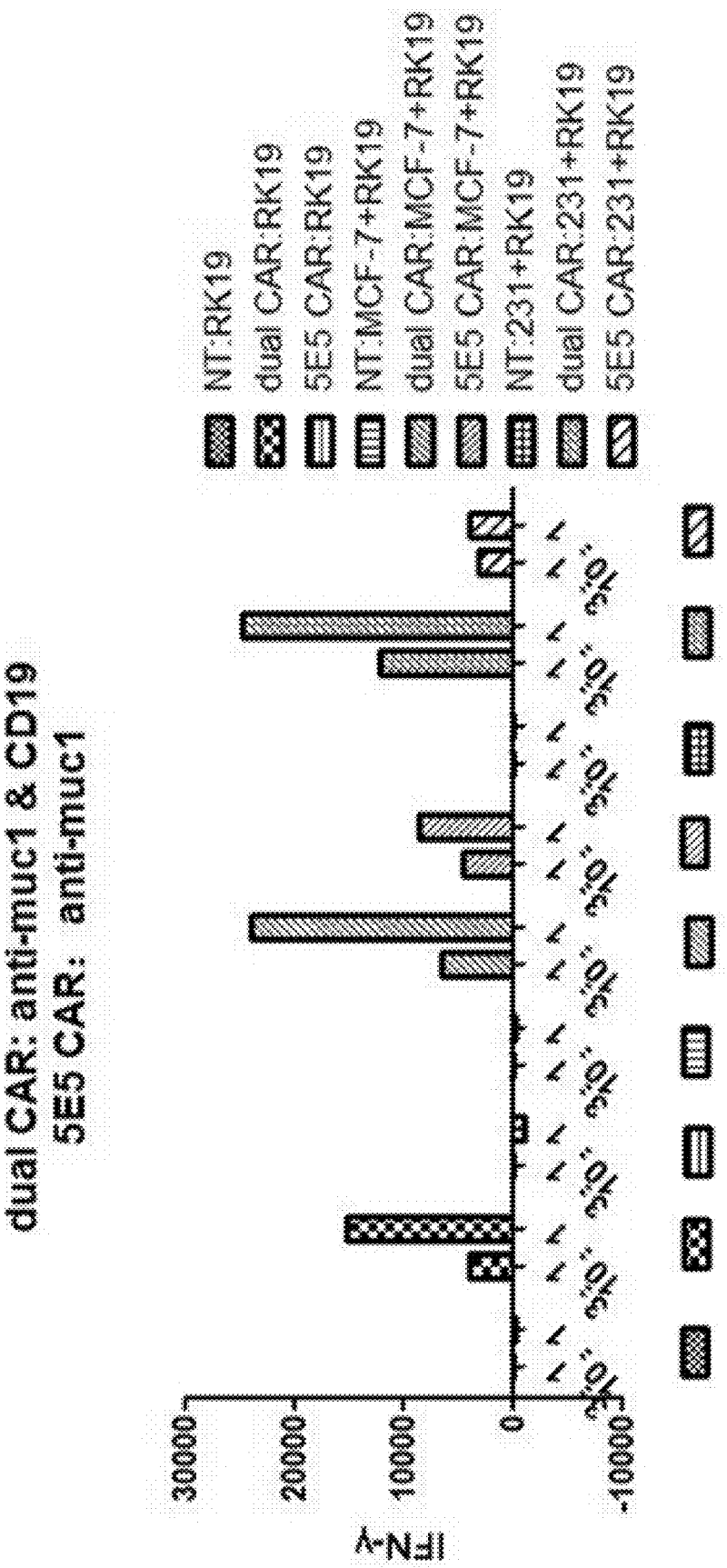
FIG. 9 displays a histogram showing T cell response to co-culturing with various substrate cells.
Figure 10:
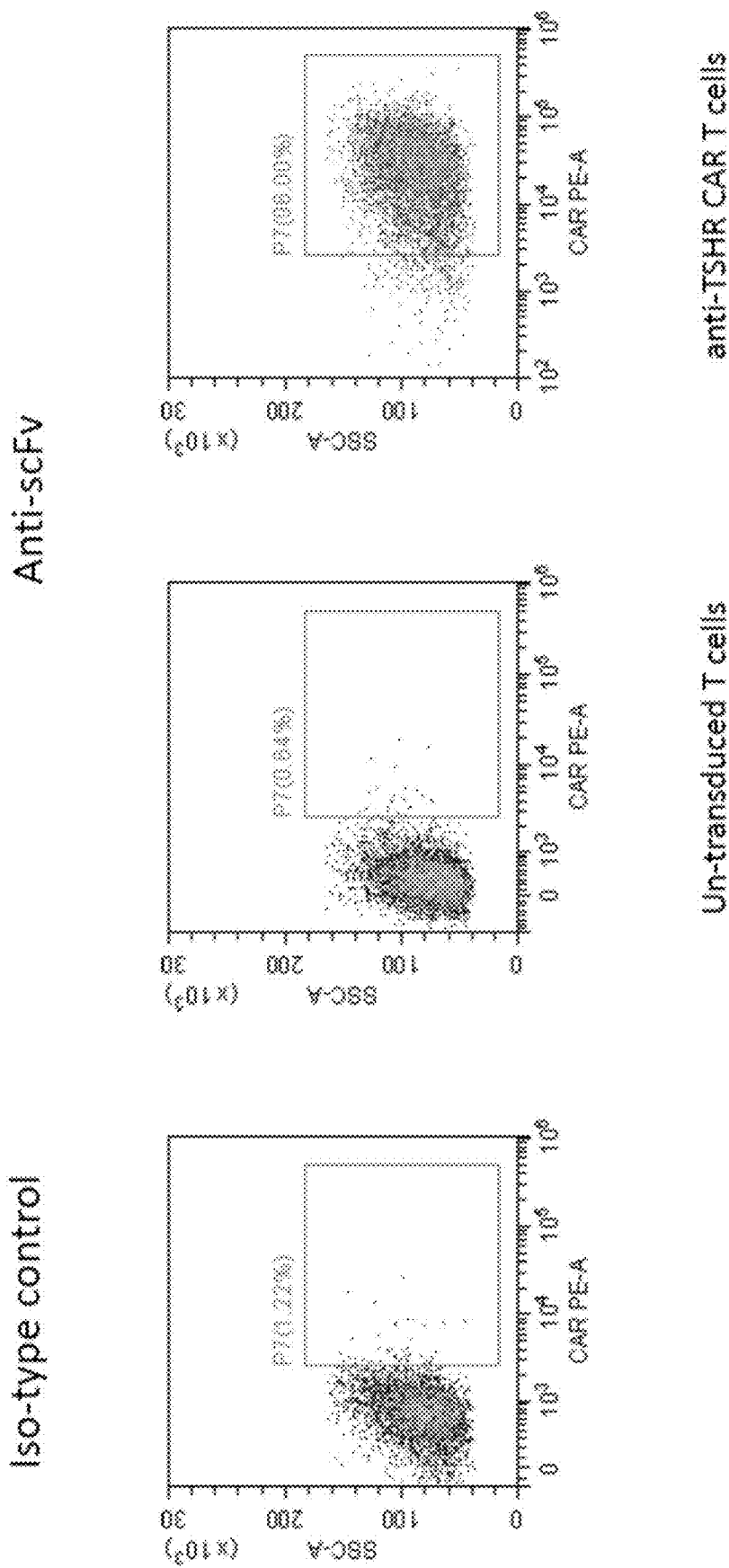
FIG. 10 displays flow cytometry analysis showing expression of anti-TSHR CAR molecules on T cells (Gated by a single live cell). Anti-TSHR CAR T cells were constructed, and the expression of CAR molecules was detected by flow cytometry. Compared to non-transduced T cells, expression of CAR molecules was observed.
Figure 11:
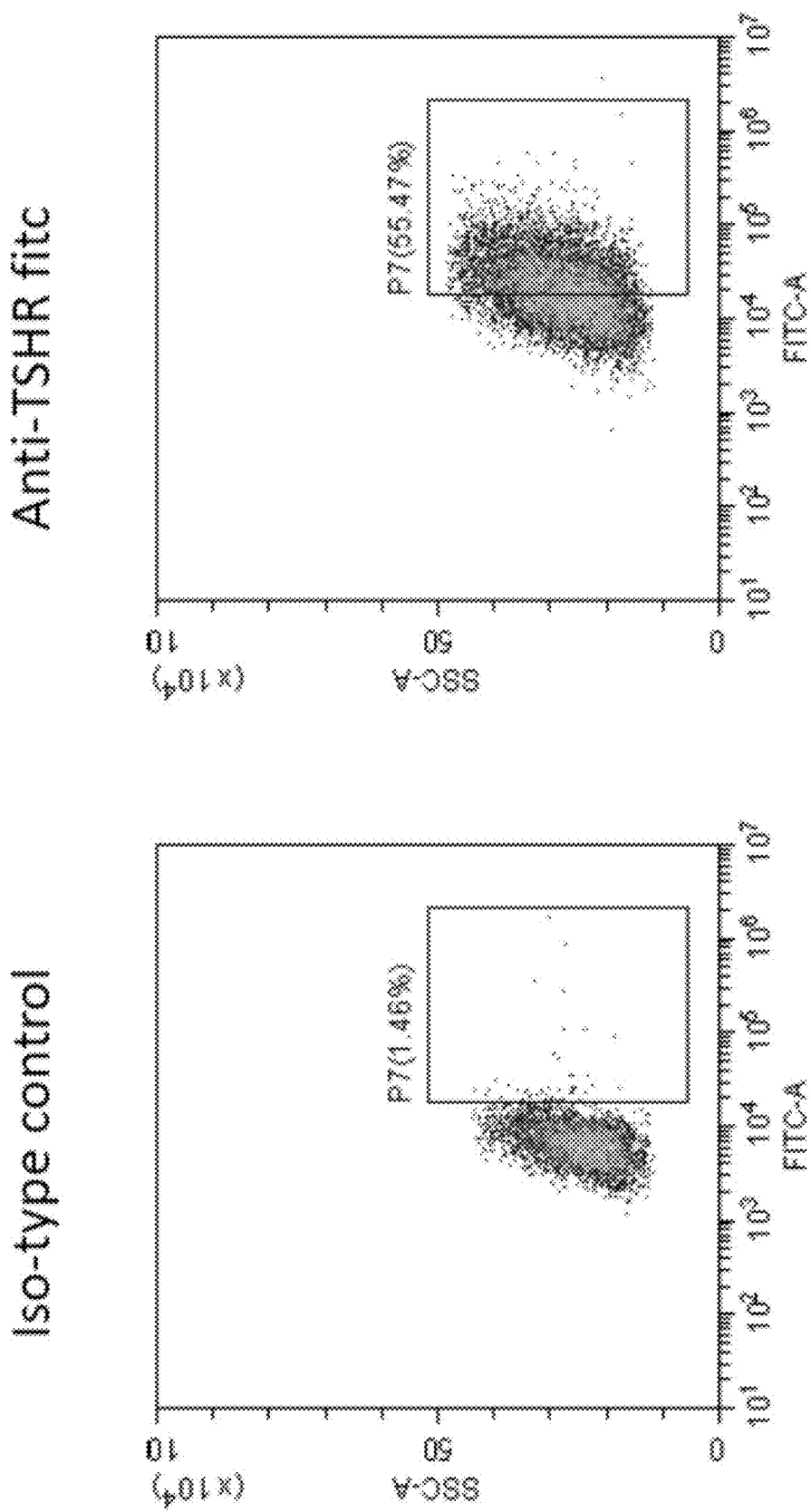
FIG. 11 displays flow cytometry analysis showing overexpression of TSHR on T cells (Gated by a single live cell). Lentiviral vectors were used to construct antigen overexpressed T cells (TSHR). The expression of TSHR molecules on the surface of T cells was observed (IgG on the left and anti-TSHR FITC on the right).
Figure 12:
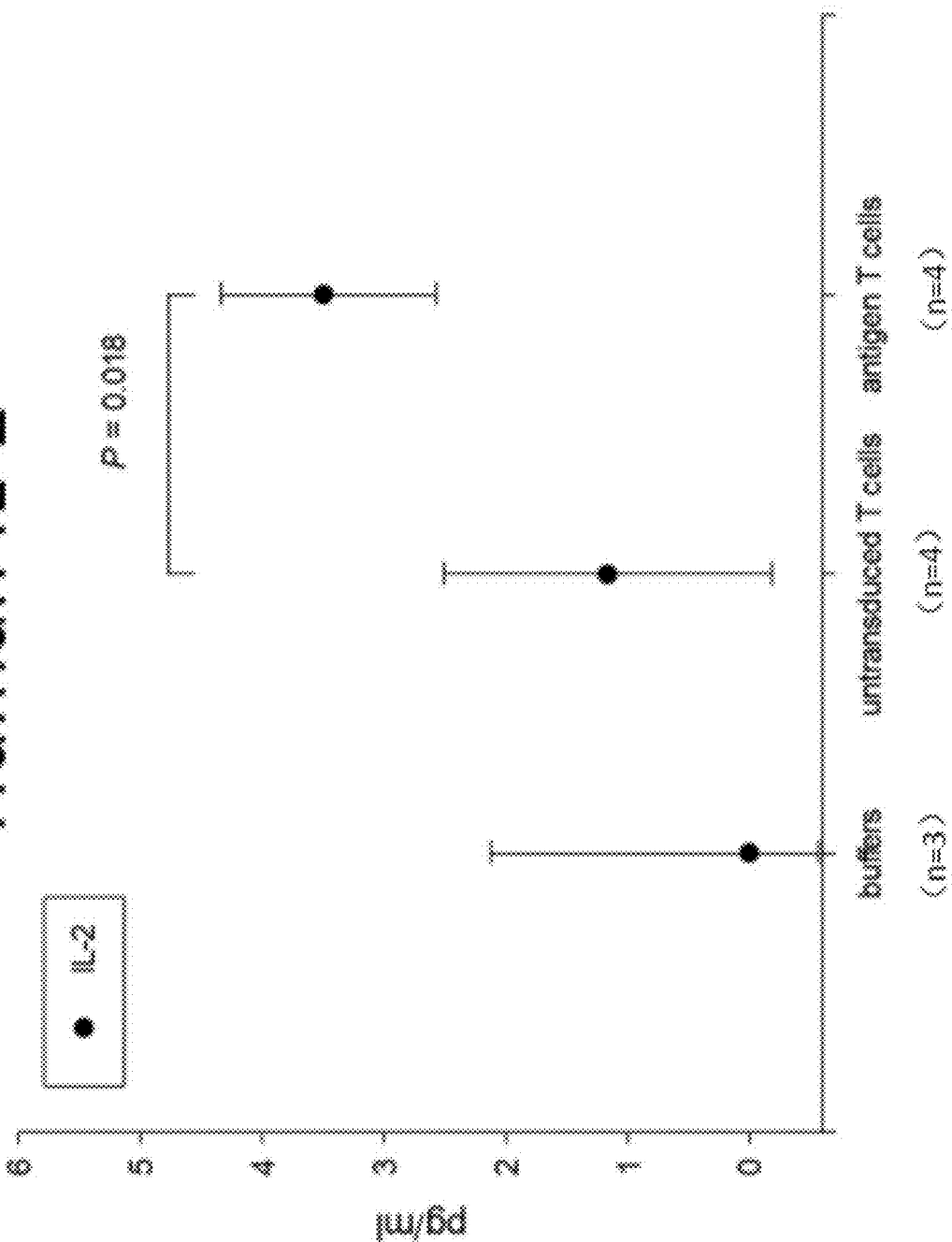
FIG. 12 shows cytokine release (IL-2) in mouse peripheral blood.
Figure 13:
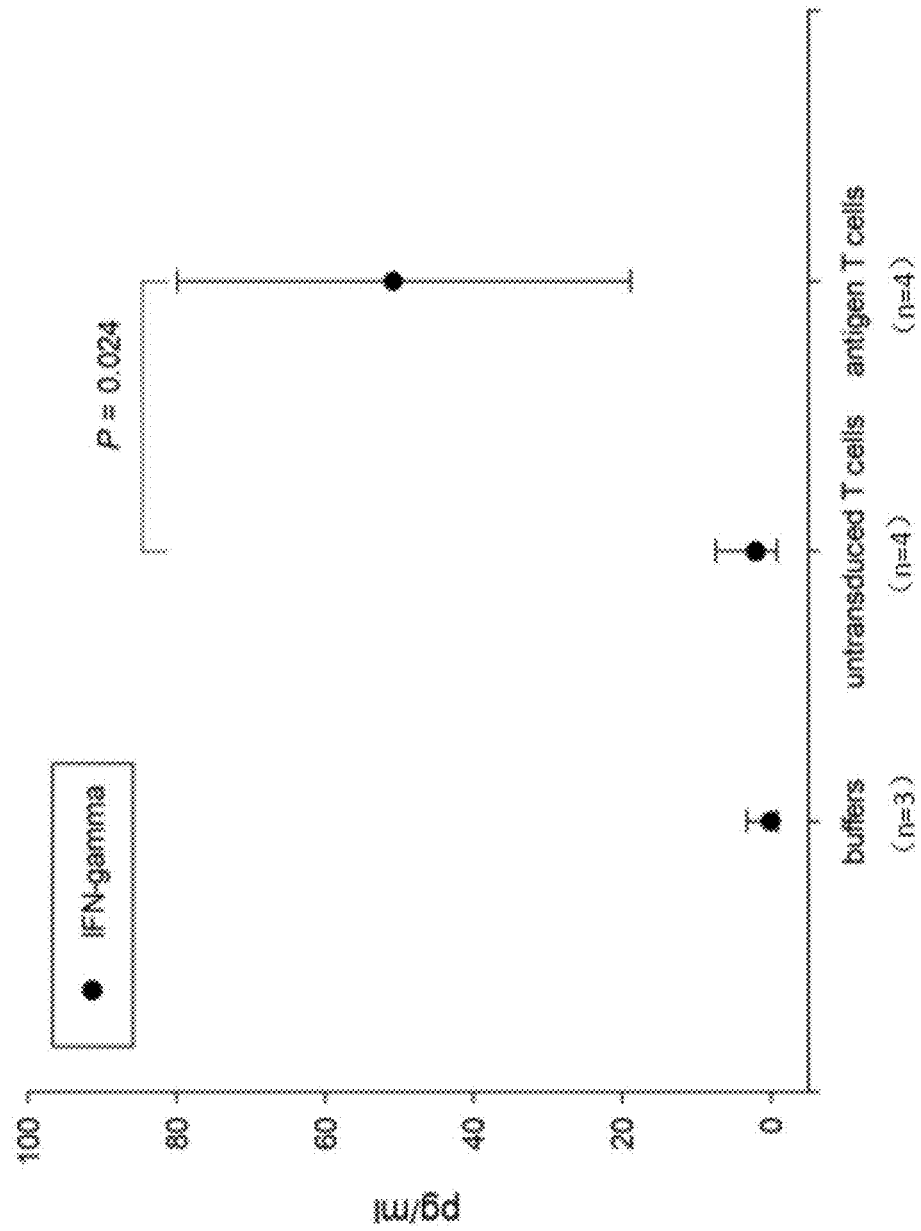
FIG. 13 shows cytokine release (IFN-gamma) in mouse peripheral blood.
Figure 14:
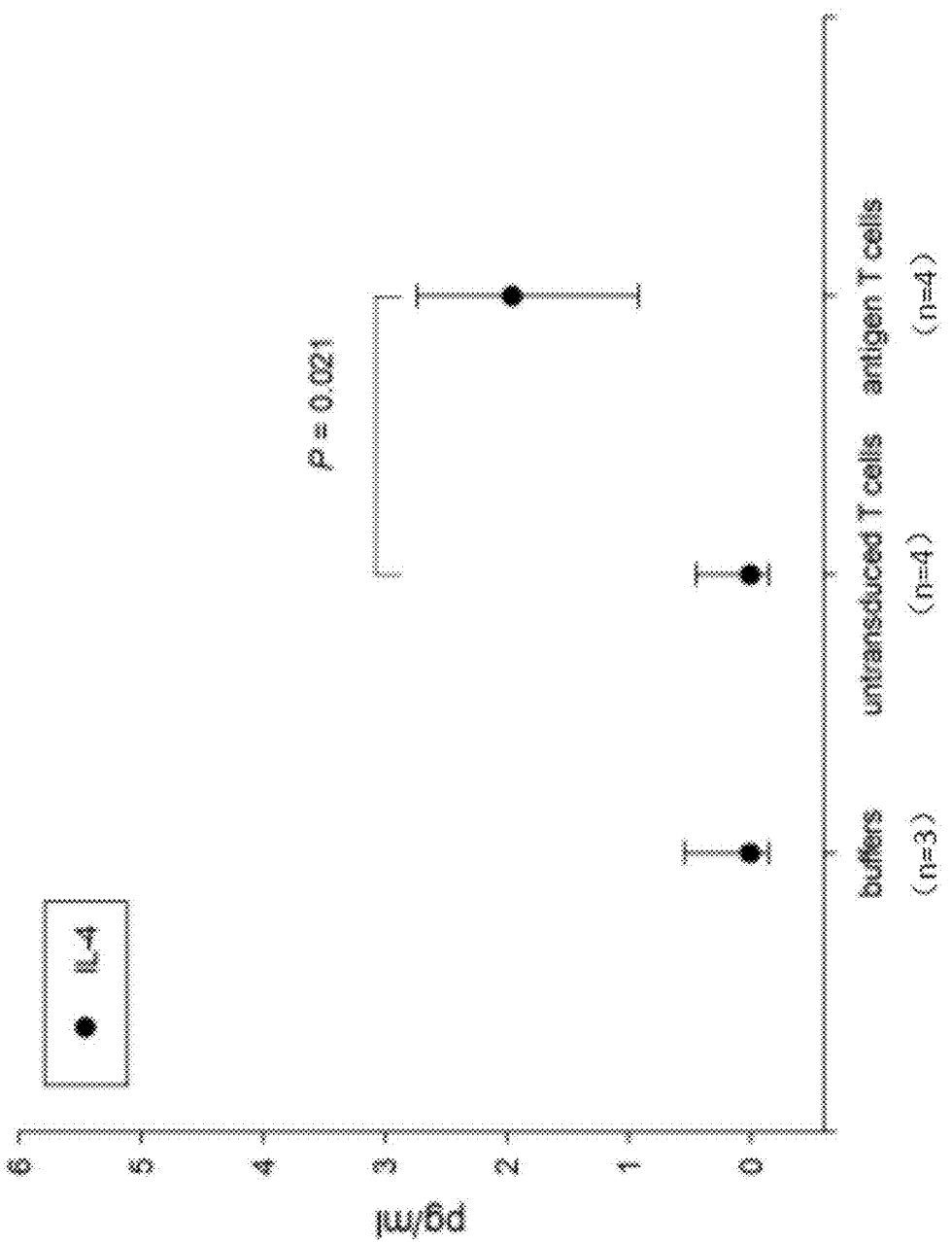
FIG. 14 shows cytokine release (IL-4) in mouse peripheral blood.
Figure 15:
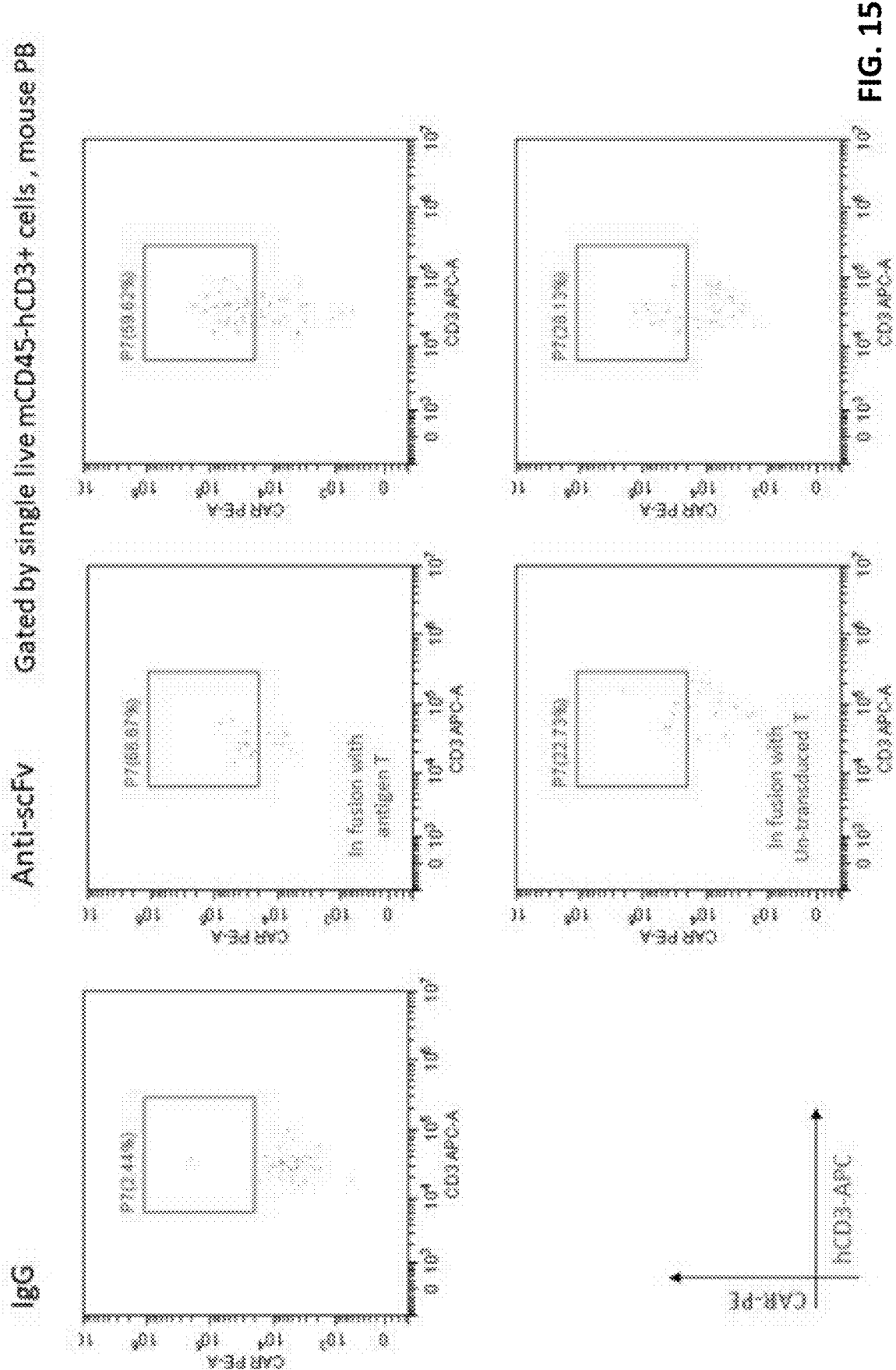
FIG. 15 shows CAR/CD3 cell ratios were increased as compared to control in mouse peripheral blood.
Figure 16:
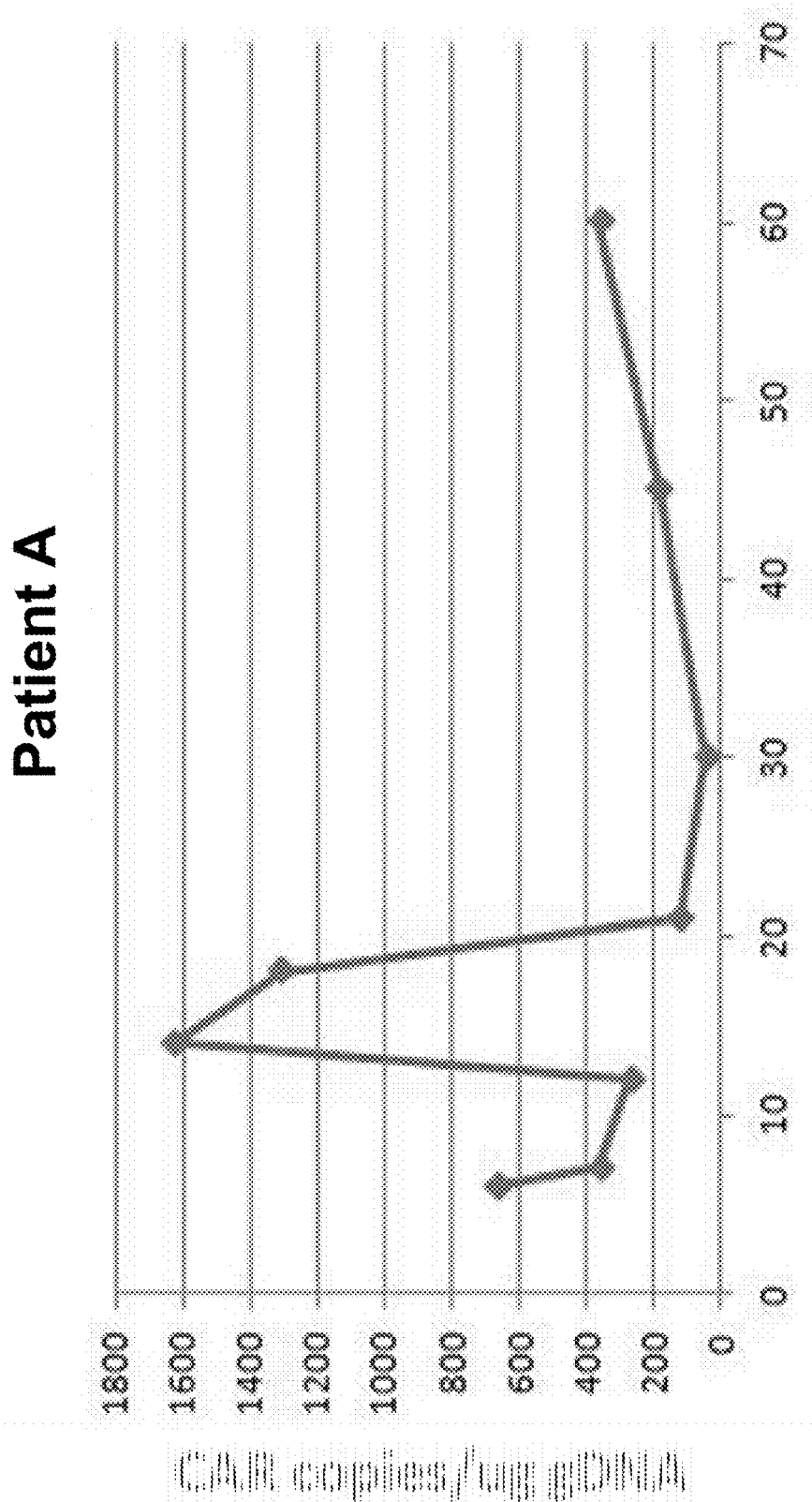
FIG. 16 shows changes in the number of copies of CAR molecules with time (days) after infusion of CAR T cells to patient A.
Figure 17:
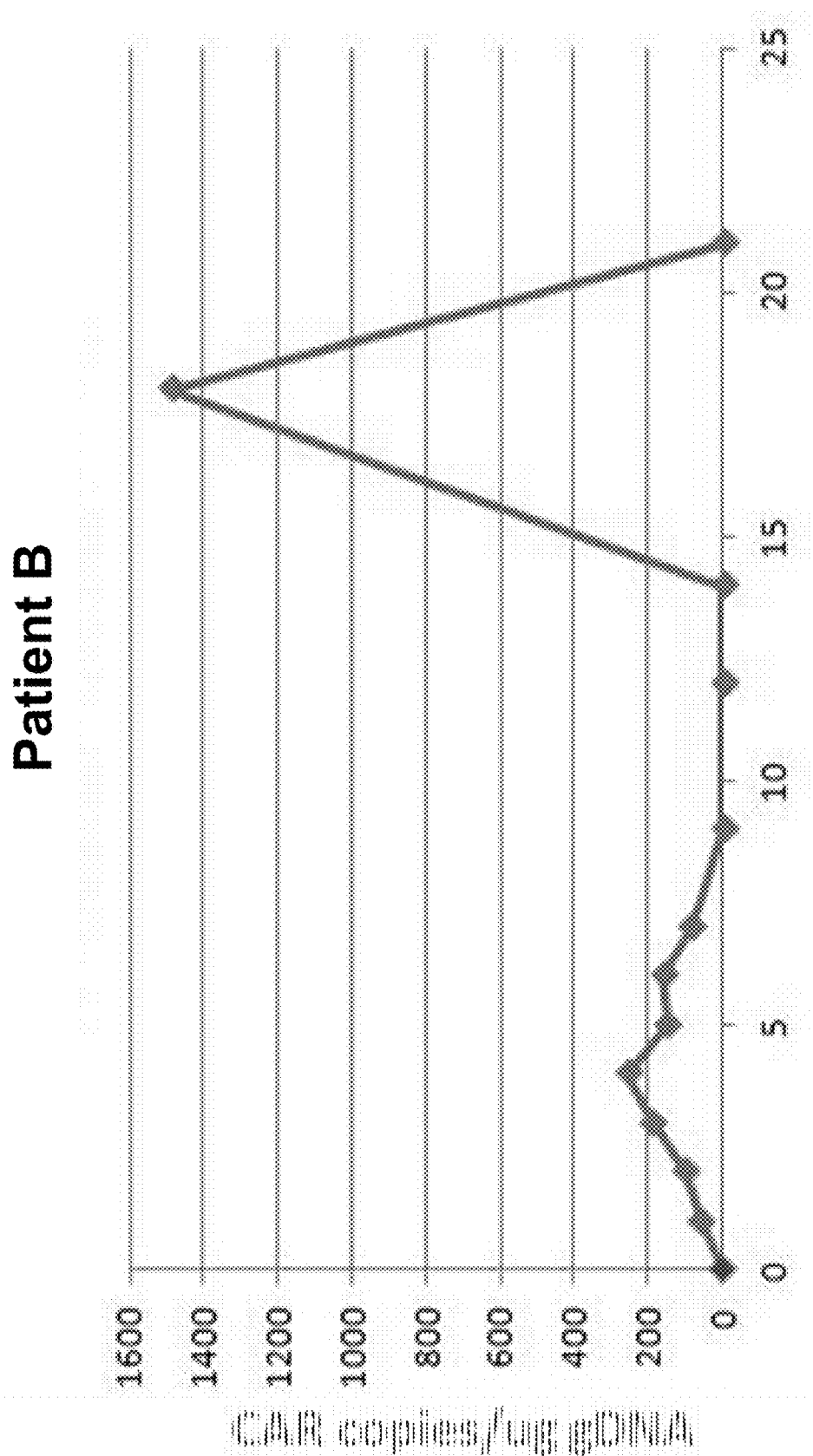
FIG. 17 shows changes in the number of copies of CAR molecules with time (days) after infusion of CAR T cells to patient B.
Figure 18:
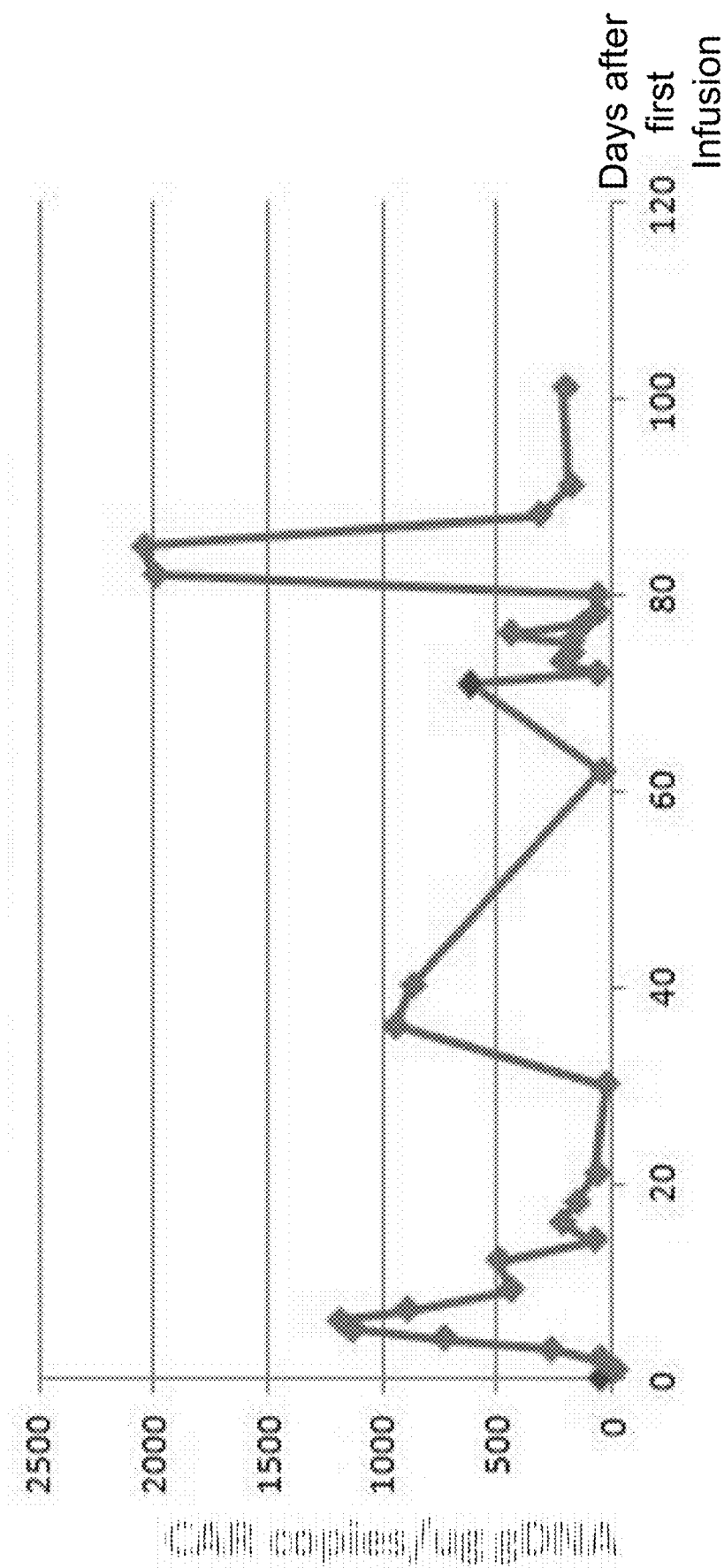
FIG. 18 shows changes in the number of copies of CAR molecules with time (days) after infusion of CAR T cells to patient C.
Figure 19:
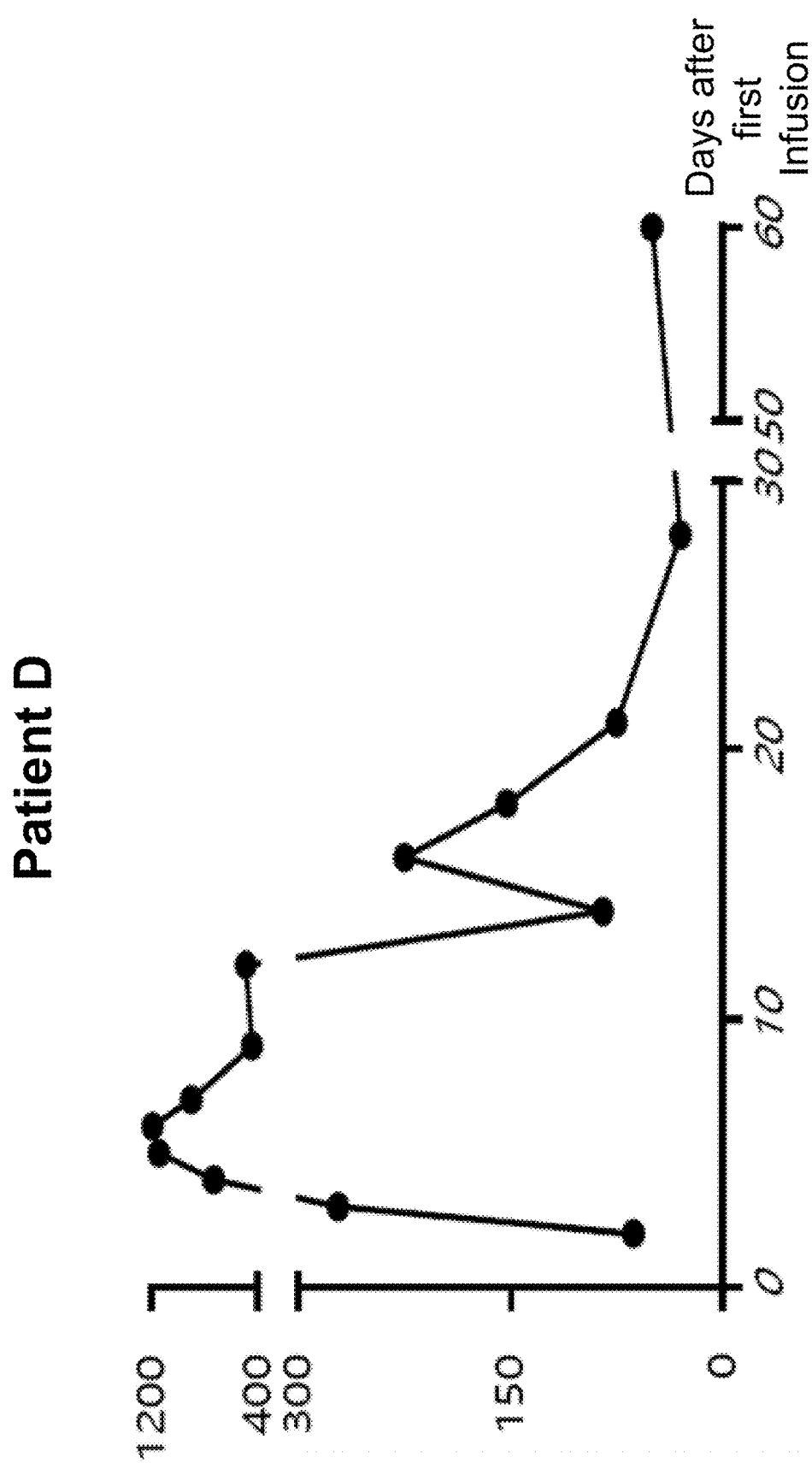
FIG. 19 shows changes in the number of copies of CAR molecules with time (days) after infusion of CAR T cells to patient D.
Figure 20:
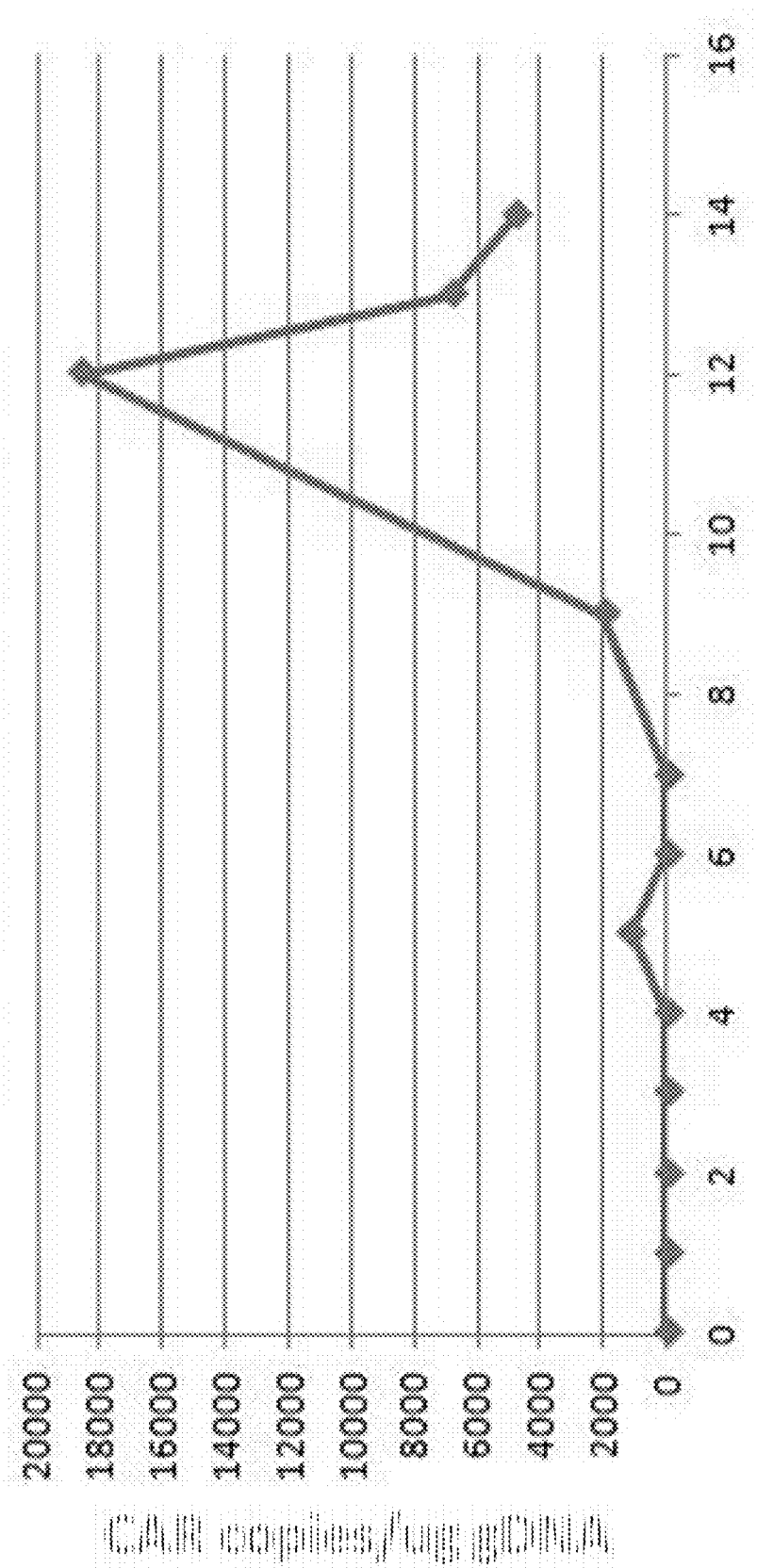
FIG. 20 shows changes in the number of copies of CAR molecules with time (days) after infusion of CAR T cells to patient E.

Primary T cells were obtained from a patient. The obtained primary T cells were divided into two groups. Primary T cells in Group 1 were transduced with lentiviral vectors including a nucleic acid sequence encoding Anti-TSHR CAR (SEQ ID: 8). Primary T cells in Group 2 were transduced with lentiviral vectors including a nucleic acid sequence encoding TSHR (SEQ ID: 20). Flow-cytometry was performed and analyzed to determine the expression of CAR and TSHR in primary T cells, respectively (FIGS. 8 and 9). Techniques related to cell cultures, construction of lentiviral vectors, and flow cytometry may be found in "Control of large, established tumor xenografts with genetically retargeted human T cells containing CD28 and CD137 domains," PNAS Mar. 3, 2009, vol. 106 no. 9, 3360-3365, which is incorporated herein by reference in its entirety.

Example 4. In Vivo Cytokine Release Assay

Primary T cells of Group 1 and Group 2 were infused into mice (Experimental Group). As a control, Primary T cells of Group 1 alone or buffer were infused into mice (Control Group 1 and Control Group 2). Several parameters regarding cell infusion are provided in Table 1 below. NPG™ (NOD Prkdc$^{scid}$ IL2rg$^{null}$) mice were irradiated, and a certain number of CAR T cells and corresponding control agents were infused into mice. For Control Group 2, three consecutive buffers were returned to the mice. For Control Group 1, T cells that did not express antigen were returned three times in succession. For Experimental Group, T cells expressing antigens were continuously transfused three times in succession. After the transfusion was completed, blood from the limbal vein was collected to analyze the T cells and factor release (e.g., cytokine release) in the peripheral blood of the mice. The mice were then sacrificed, and T ratios of each organ/CAR T Cell ratio/CAR T copy and other data were collected. Cytokine release assay was then performed. Various cytokines (e.g., IFNg, IL4, IL2) in mice peripheral blood were measured for Experimental Group and Control Group. As shown in FIGS. 10-13, the amount of cytokine released in the Experimental Group was greater than those in the Control Group. These results demonstrate that infusion of cells expressing an antigen enhances the corresponding CAR T cells' T cell response. Table 2 summarizes the infusion of T cells into mice, and Table 3 provides the schedule for in vivo analysis cytokine release.

TABLE 2

| Experimental Group | Control Group 1 | Control Group 2 |
|---|---|---|
| Anti-TSHR CAR T cells about $4 \times 10^6$/mouse Antigen T (TSHR-overexpressed T cell) about $4 \times 10^6$/mouse per time | Anti-TSHR CAR T cells about $4 \times 10^6$/mouse NT (non-transduced T cell) about $4 \times 10^6$/mouse per time | Anti-TSHR CAR T cells about $4 \times 10^6$/mouse NT (non-transduced T cell) about $4 \times 10^6$/mouse per time |

TABLE 3

| Day 1 | Day 3 | Day 5 | Day 9 | Day 12 | Day 14 | Day 21 | Day 28 |
|---|---|---|---|---|---|---|---|
| irradiation at 1.5 Gy | anti-TSHR CART cells infusion | buffers/nt/ antigen T infusion | buffers/nt/ antigen T infusion | buffers/nt/ antigen T infusion | bleeding and analysis | bleeding and analysis | sacrifice and analysis |

The following table (Table 4) shows various polypeptide domains and nucleic acid constructs and their Sequence Identifiers (SEQ ID NO). (CD19 refers to CD19 CAR; MUC1 refers to tMUC1 CAR; A, B, C, and D refer to specific sequences of hinge and/or transmembrane domain of corresponding CARs)

TABLE 4

| Name | SEQ ID NO: | Name | SEQ ID NO: | Name | SEQ ID No: |
|---|---|---|---|---|---|
| SP | 1 | UPK2 | 101 | Construct of MUC1-5E5-A-IRES-CD19-A | 201 |
| Hinge & transmembrane domain | 2 | ADAM12 | 102 | CAR 1 of MUC1-5E5-A-IRES-CD19-A | 202 |
| Co-stimulatory region | 3 | SLC45A3 | 103 | CAR 2 of MUC1-5E5-A-IRES-CD19-A | 203 |
| CD3-zeta | 4 | ACPP | 104 | Construct of MUC1-5E5-B-IRES-CD19-A | 204 |
| scFV Humanized CD19 | 5 | MUC21 | 105 | CAR 1 of MUC1-5E5-B-IRES-CD19-A | 205 |
| scFV CD19 | 6 | MUC16 | 106 | CAR 2 of MUC1-5E5-B-IRES-CD19-A | 203 |
| scFv FZD10 | 7 | MS4A12 | 107 | Construct of MUC1-5E5-A-IRES-CD19-B | 206 |
| scFv TSHR | 8 | ALPP | 108 | CAR 1 of MUC1-5E5-A-IRES-CD19-B | 202 |
| scFv PRLR | 9 | SLC2A14 | 109 | CAR 2 of MUC1-5E5-A-IRES-CD19-B | 207 |
| scFv Muc 17 | 10 | GS1-259H13.2 | 110 | Construct of MUC1-5E5-B-IRES-CD19-B | 208 |
| scFv GUCY2C | 11 | ERVFRD-1 | 111 | CAR 1 of MUC1-5E5-B-IRES-CD19-B | 205 |
| scFv CD207 | 12 | ADGRG2 | 112 | CAR 2 of MUC1-5E5-B-IRES-CD19-B | 207 |
| Prolactin (ligand) | 13 | ECEL1 | 113 | Construct of MUC1-2-A-IRES-CD19-A | 209 |
| scFv CD3 | 14 | CHRNA2 | 114 | CAR 1 of MUC1-2-A-IRES-CD19-A | 210 |
| scFv CD4 | 15 | GP2 | 115 | CAR 2 of MUC1-2-A-IRES-CD19-A | 203 |
| scFv CD4-2 | 16 | PSG9 | 116 | Construct of MUC1-2-B-IRES-CD19-A | 211 |
| scFv CD5 | 17 | SIGLEC15 | 117 | CAR 1 of MUC1-2-B-IRES-CD19-A | 212 |

TABLE 4-continued

| Name | SEQ ID NO: | Name | SEQ ID NO: | Name | SEQ ID No: |
|---|---|---|---|---|---|
| CD19 antigen | 18 | SLC6A3 | 118 | CAR 2 of MUC1-2-B-IRES-CD19-A | 203 |
| FZD10 antigen | 19 | KISS1R | 119 | Construct of MUC1-2-A-IRES-CD19-B | 213 |
| TSHR antigen | 20 | QRFPR | 120 | CAR 1 of MUC1-2-A-IRES-CD19-B | 210 |
| PRLR antigen | 21 | GPR119 | 121 | CAR 2 of MUC1-2-A-IRES-CD19-B | 207 |
| Muc 17 antigen | 22 | CLDN6 | 122 | Construct of MUC1-2-B-IRES-CD19-B | 214 |
| GUCY2C antigen | 23 | SP-2 | 123 | CAR 1 of MUC1-2-B-IRES-CD19-B | 212 |
| CD207 antigen | 24 | Linker-2 | 124 | CAR 2 of MUC1-2-B-IRES-CD19-B | 207 |
| CD3 antigen | 25 | Hinge-2 | 125 | Construct of MUC1-5E5-A-IRES-hCD19-A | 215 |
| CD4 antigen | 26 | TM-2 | 126 | CAR 1 of MUC1-5E5-A-IRES-hCD19-A | 202 |
| CD5 antigen | 27 | 4-1BB-2 | 127 | CAR2 of MUC1-5E5-A-IRES-hCD19-A | 216 |
| CAR CD19 nucleic acid | 28 | CD3 zeta-2 | 128 | Construct of MUC1-5E5-B-IRES-hCD19-A | 217 |
| Hinge & TM domain B | 29 | CLDN6-CAR-1 | 129 | CAR 1 of MUC1-5E5-B-IRES-hCD19-A | 205 |
| Hinge & TM domain A | 30 | ScFv CLDN6-CAR-1 | 130 | CAR2 of MUC1-5E5-B-IRES-hCD19-A | 216 |
| Hinge & TM domain D | 31 | ScFv VL CLDN6-CAR-1 | 131 | Construct of MUC1-5E5-A-IRES-hCD19-B | 218 |
| Hinge & TM domain C | 32 | ScFv VH CLDN6-CAR-1 | 132 | CAR 1 of MUC1-5E5-A-IRES-hCD19-B | 202 |
| Hinge domain D | 33 | CLDN6-CAR-2 | 133 | CAR 2 of MUC1-5E5-A-IRES-hCD19-B | 219 |
| Hinge domain C | 34 | ScFv CLDN6-CAR-2 | 134 | Construct of MUC1-5E5-B-IRES-hCD19-B | 220 |
| Hinge domain B | 35 | ScFv VL CLDN6-CAR-2 | 135 | CAR 1 of MUC1-5E5-B-IRES-hCD19-B | 205 |
| Hinge domain A | 36 | ScFv VH CLDN6-CAR-2 | 136 | CAR2 of MUC1-5E5-B-IRES-hCD19-B | 219 |
| TM domain D | 37 | CLDN6-CAR-3 | 137 | Construct of MUC1-2-A-IRES-hCD19-A | 221 |
| TM domain A | 38 | scFv CLDN6-CAR-3 | 138 | CAR 1 of MUC1-2-A-IRES-hCD19-A | 210 |
| CD19 extracellular domain | 39 | scFv VL CLDN6-CAR-3 | 139 | CAR 2 of MUC1-2-A-IRES-hCD19-A | 216 |
| TM domain C or B | 40 | scFv VH CLDN6-CAR-3 | 140 | Construct of MUC1-2-B-IRES-hCD19-A | 222 |
| WTCD3zeta | 41 | CLDN6-CAR-4 | 141 | CAR 2CAR 1 of MUC1-2-B-IRES-hCD19-A | 212 |
| WTCD3zeta-BCMACAR full length | 42 | scFv CLDN6-CAR-4 | 142 | Construct of MUC1-2-B-IRES-hCD19-A | 216 |
| BCMA | 43 | scFv VL CLDN6-CAR-4 | 143 | Construct of MUC1-2-A-IRES-hCD19-B | 223 |
| BCMA CAR vector | 44 | scFv VH CLDN6-CAR-4 | 144 | CAR 1 of MUC1-2-A-IRES-hCD19-B | 210 |
| BCMA CAR vector | 45 | SIGLEC-15-CAR-1 | 145 | CAR 2 of MUC1-2-A-IRES-hCD19-B | 219 |

TABLE 4-continued

| Name | SEQ ID NO: | Name | SEQ ID NO: | Name | SEQ ID No: |
|---|---|---|---|---|---|
| VL anti-CD5 | 46 | scFv SIGLEC-15-CAR-1 | 146 | Construct of MUC1-2-B-IRES-hCD19-B | 224 |
| VH anti-CD5 | 47 | scFv VL SIGLEC-15-CAR-1 | 147 | CAR 1 of MUC1-2-B-IRES-hCD19-B | 212 |
| VL anti-CD4 | 48 | scFv VH SIGLEC-15-CAR-1 | 148 | CAR 2 of MUC1-2-B-IRES-hCD19-B | 219 |
| VH anti-CD4 | 49 | VL1 VH1 SIGLEC-15-CAR-2 | 149 | Construct of MUC1-5E5-A-IRES-CD22-A | 225 |
| VL anti-CD3 | 50 | VL1 VH2 SIGLEC-15-CAR-3 | 150 | CAR 1 of MUC1-5E5-A-IRES-CD22-A | 202 |
| VH anti-CD3 | 51 | VL1 VH3 SIGLEC-15-CAR-4 | 151 | CAR 2 of MUC1-5E5-A-IRES-CD22-A | 226 |
| TSHR extracellular domain | 52 | VL1 VH 4 SIGLEC-15-CAR-5 | 52 | Construct of MUC1-5E5-B-IRES-CD22-A | 227 |
| VH region of BCMA scFv | 53 | VL2 VH 1 SIGLEC-15-CAR-6 | 153 | CAR 1 of MUC1-5E5-A-IRES-CD22-A | 205 |
| VL region of BCMA scFv | 54 | VL2 VH2 SIGLEC-15-CAR-7 | 154 | CAR 2 of MUC1-5E5-A-IRES-CD22-A | 226 |
| VH region of CD14 scFv | 55 | VL2 VH3 SIGLEC-15-CAR-8 | 155 | Construct of MUC1-5E5-A-IRES-CD22-B | 228 |
| VL region of CD14 scFv | 56 | VL2 VH4 SIGLEC-15-CAR-9 | 156 | MUC1-5E5-A-IRES-CD22-B CAR 1 | 202 |
| VH region of CD33 scFv | 57 | VL1 SIGLEC-15-CAR | 157 | MUC1-5E5-A-IRES-CD22-B CAR 2 | 229 |
| VL region of CD33 scFv | 58 | VL2 SIGLEC-15-CAR | 158 | MUC1-5E5-B-IRES-CD22-B | 230 |
| CD22CAR | 59 | VH1 SIGLEC-15-CAR | 159 | CAR 1 of MUC1-5E5-B-IRES-CD22-B | 205 |
| BCMACAR | 60 | VH2 SIGLEC-15-CAR | 160 | CAR 2 of MUC1-5E5-B-IRES-CD22-B | 229 |
| MUC1CAR | 61 | VH3 SIGLEC-15-CAR | 161 | Construct of MUC1-2-A-IRES-CD22-A | 231 |
| m19CAR-IRES-MUC1CAR | 62 | VH4 SIGLEC-15-CAR | 162 | CAR 1 of MUC1-2-A-IRES-CD22-A | 210 |
| hCD19CAR-IRES-MUC1CAR | 63 | MUC16-CAR-1 | 163 | CAR 2 of MUC1-2-A-IRES-CD22-A | 226 |
| hCD22CAR-IRES-MUC1CAR | 64 | scFv MUC16-CAR-1 | 164 | MUC1-2-B-IRES-CD22-A | 232 |
| BCMACAR-IRES-MUC1CAR | 65 | scFv VL MUC16-CAR-1 | 165 | MUC1-2-B-IRES-CD22-A CAR 1 | 212 |
| mCD19CAR-2A-MUC1CAR | 66 | scFv VH MUC16-CAR-1 | 166 | MUC1-2-B-IRES-CD22-A CAR 2 | 226 |
| hCD19CAR-2A-MUC1CAR | 67 | MUC16-CAR-2 | 167 | MUC1-2-A-IRES-CD22-B | 233 |
| hCD22CAR-2A-MUC1CAR | 68 | scFv MUC16-CAR-2 | 168 | MUC1-2-A-IRES-CD22-B CAR 1 | 210 |
| BCMA-2A-MUC1CAR | 69 | scFv VL MUC16-CAR-2 | 169 | MUC1-2-A-IRES-CD22-B CAR 2 | 229 |
| Tumor associated MUC1 scFv 1 | 70 | scFv VH MUC16-CAR-2 | 170 | Construct of MUC1-2-B-IRES-CD22-B | 234 |
| Tumor associated MUC1 scFv-1 VH | 71 | KISS1R-CAR | 171 | CAR 1 of MUC1-2-B-IRES-CD22-B | 212 |
| Tumor associated MUC1 scFv-1 VL | 72 | Ligent peptide KISS1R-CAR | 172 | CAR 2 of MUC1-2-B-IRES-CD22-B | 229 |
| Tumor associated MUC1 scFv-1 VL CDR 1 | 73 | ZFLm1 (left) RS aa | 173 | Construct of MUC1-5E5-A-IRES-CD14-A | 235 |
| L2D8-2 (hCAR VL) | 74 | ZFLm1 (left) F1 | 174 | CAR 1 of MUC1-5E5-A-IRES-CD14-A | 202 |
| Tumor associated MUC1 scFv-1 VL CDR 3 | 75 | ZFLm1 (left) F2 | 174 | CAR 2 of MUC1-5E5-A-IRES-CD14-A | 236 |

TABLE 4-continued

| Name | SEQ ID NO: | Name | SEQ ID NO: | Name | SEQ ID No: |
|---|---|---|---|---|---|
| Tumor associated MUC1 scFv-1 VH CDR 1 | 76 | ZFLm1 (left) F3 | 176 | Construct of MUC1-5E5-B-IRES-CD14-A | 237 |
| Tumor associated MUC1 scFv-1 VH CDR 2 | 77 | ZFLm1 (left) F4 | 177 | CAR 1 of MUC1-5E5-B-IRES-CD14-A | 205 |
| Tumor associated MUC1 scFv-1 VH CDR 3 | 78 | ZFLm1 (left) F5 | 178 | CAR 2 of MUC1-5E5-B-IRES-CD14-A | 236 |
| Tumor associated MUC1 scFv2 | 79 | ZFLm1 (left) F6 | 179 | Construct of MUC1-5E5-A-IRES-CD14-B | 238 |
| Tumor associated MUC1 scFv2 VH | 80 | ZFRm1-4 (right) RS aa | 180 | CAR 1 of MUC1-5E5-A-IRES-CD14-B | 202 |
| Tumor associated MUC1 scFv2 VL | 81 | ZFRm1-4 (right) F1 | 181 | CAR 2 of MUC1-5E5-A-IRES-CD14-B | 239 |
| Tumor associated MUC1 scFv-2 VL CDR 1 | 82 | ZFRm1-4 (right) F2 | 182 | Construct of MUC1-2-A-IRES-CD14-A | 240 |
| Tumor associated MUC1 scFv-2 VL CDR 2 | 83 | ZFRm1-4 (right) F3 | 184 | CAR 1 of MUC1-2-A-IRES-CD14-A | 210 |
| Tumor associated MUC1 scFv-2 VL CDR 3 | 84 | ZFRm1-4 (right) F4 | 184 | CAR 2 of MUC1-2-A-IRES-CD14-A | 236 |
| `Tumor associated MUC1 scFv-2VH CDR 1 | 85 | δ chain-1 of Vγ9Vδ2 | 185 | Construct of MUC1-2-B-IRES-CD14-A | 241 |
| Tumor associated MUC1 scFv-2 VH CDR 2 | 86 | γ chain-2 of Vγ9Vδ2 | 186 | CAR 1 of MUC1-2-B-IRES-CD14-A | 212 |
| Tumor associated MUC1 scFv-2 VH CDR 3 | 87 | δ chain-2 of Vγ9Vδ2 | 187 | CAR 2 of MUC1-2-B-IRES-CD14-A | 236 |
| GSTA motif | 88 | Vγ9Vδ2 TCR-1: DG. SF13 γ chain | 188 | Construct of MUC1-2-A-IRES-CD14-B | 242 |
| Modified PD-1 intracellular domain -1 | 89 | Vγ9Vδ2 TCR-1: DG. SF13 δ chain | 189 | CAR 1 of MUC1-2-A-IRES-CD14-B | 210 |
| Modified PD-1 intracellular domain -2 | 90 | Vγ9Vδ2 TCR-2: DG. SF68: γ chain | 190 | CAR 2 of MUC1-2-A-IRES-CD14-B | 239 |
| Modified PD-1 intracellular domain -3 | 91 | Vγ9Vδ2 TCR-2: DG. SF68: δ chain | 191 | Construct of MUC1-2-B-IRES-CD14-B | 243 |
| Modified PD-1 intracellular domain -4 | 92 | Vγ9Vδ2 TCR-3: 12G12: γ chain | 192 | CAR 1 of MUC1-2-B-IRES-CD14-B | 212 |
| Modified PD-1 intracellular domain -5 | 93 | Vγ9Vδ2 TCR-3: 12G12: δ chain | 193 | CAR 2 of MUC1-2-B-IRES-CD14-B | 239 |
| Removed PD-1 intracellular domain -1 | 94 | Vγ9Vδ2 TCR-4: CP.1.15 γ chain | 194 | Construct of MUC1-5E5-A-IRES-BCMA-A | 244 |
| Removed PD-1 intracellular domain -2 | 95 | TCR-4: CP. 1.15δ chain | 195 | CAR 1 of MUC1-5E5-A-IRES-BCMA-A | 202 |
| FokI WC | 96 | WT CD3-zeta | 196 | CAR 2 of MUC1-5E5-A-IRES-BCMA-A | 245 |
| M FokI | 97 | Invariant sequence for iNKT α chain (hVα24-JαQ-TRAC) | 197 | Construct of MUC1-5E5-B-IRES-BCMA-A | 246 |
| M FokI | 98 | An example for iNKT β chain sequence (containing Vβ11): | 198 | CAR 1 of MUC1-5E5-B-IRES-BCMA-A | 205 |
| γ chain-1 of Vγ9Vδ2 | 99 | Invariant sequence for MAIT α chain ( hAV7S2-AJ33 α chain) (version 1) | 199 | CAR 2 of MUC1-5E5-B-IRES-BCMA-A | 245 |
| VL anti-CD4-2 | 100 | VH anti- CD4-2 | 200 | Construct of MUC1-5E5-A-IRES-BCMA-B | 247 |

TABLE 4-continued

| Name | SEQ ID NO: | Name | SEQ ID NO: | Name | SEQ ID No: |
|---|---|---|---|---|---|
| CAR 1 of MUC1-2-A-IRES-CD33-A | 210 | CAR 1 of MUC1-5E5-B-IRES-CD33-A | 205 | CAR 1 of MUC1-5E5-A-IRES-BCMA-B | 202 |
| CAR 2 of MUC1-2-A-IRES-CD33-A | 255 | CAR 2 of MUC1-5E5-B-IRES-CD33-A | 255 | CAR 2 of MUC1-5E5-A-IRES-BCMA-B | 248 |
| Construct ofMUC1-2-B-IRES-CD33-A | 261 | Construct ofMUC1-5E5-A-IRES-CD33-B | 257 | Construct of MUC1-5E5-B-IRES-BCMA-B | 249 |
| CAR 1 of MUC1-2-B-IRES-CD33-A | 212 | CAR 1 of MUC1-5E5-A-IRES-CD33-B | 202 | CAR 1 of MUC1-5E5-B-IRES-BCMA-B | 202 |
| CAR 2 of MUC1-2-B-IRES-CD33-A | 255 | CAR 2 of MUC1-5E5-A-IRES-CD33-B | 258 | CAR 2 of MUC1-5E5-B-IRES-BCMA-B | |
| Construct ofMUC1-2-A-IRES-CD33-B | 262 | Construct ofMUC1-5E5-B-IRES-CD33-B | 259 | Construct of MUC1-2-A-IRES-BCMA-A | 250 |
| CAR 1 of MUC1-2-A-IRES-CD33-B | 210 | CAR 1 of MUC1-5E5-B-IRES-CD33-B | 205 | CAR 1 of MUC1-2-A-IRES-BCMA-A | 210 |
| CAR 2 of MUC1-2-A-IRES-CD33-B | 258 | CAR 2 of MUC1-5E5-B-IRES-CD33-B | 258 | CAR 2 of MUC1-2-A-IRES-BCMA-A | 245 |
| Construct ofMUC1-2-B-IRES-CD33-B | 263 | Construct ofMUC1-2-A-IRES-CD33-A | 260 | Construct of MUC1-2-B-IRES-BCMA-A | 251 |
| CAR 1 of MUC1-2-B-IRES-CD33-B | 212 | Construct ofMUC1-2-B-IRES-BCMA-B | 253 | CAR 1 of MUC1-2-B-IRES-BCMA-A | 212 |
| CAR 2 of MUC1-2-B-IRES-CD33-B | 258 | CAR 1 of MUC1-2-B-IRES-BCMA-B | 212 | CAR 2 of MUC1-2-B-IRES-BCMA-A | 245 |
| Construct ofMUC1-5E5-A-IRES-CD33-A | 254 | MUC1-2-B-IRES-BCMA-B CAR 2 | 248 | Construct of MUC1-2-A-IRES-BCMA-B | 252 |
| CAR 1 of MUC1-5E5-A-IRES-CD33-A | 202 | MUC1-5E5-B-IRES-CD33-A | 256 | CAR 1 of MUC1-2-A-IRES-BCMA-B | 210 |
| CAR 2 of MUC1-5E5-A-IRES-CD33-A | 255 | CAR 2 of MUC1-2-A-IRES-BCMA-B | 248 | Mcu1-5e5Panko-enhanced scFc | 264 |
| Mcu1-Panko5e5-enhanced scFc | 265 | hinge and/or transmembrane domain A | 266 | hinge and/or transmembrane domain B | 267 |
| hinge and/or transmembrane domain C | 268 | hinge and/or transmembrane domain D | 269 | Mcu1-5e5Panko-enhanced scFc A 41BB CD2 zeta | 270 |
| Mcu1-5e5Panko-enhanced scFc B41BB CD2 zeta | 271 | Mcu1-5e5Panko-enhanced scFc C 41BB CD2 zeta | 272 | Mcu1-5e5Panko-enhanced scFc D 41BB CD2 zeta | 273 |
| Mcu1-Panko5e5-enhanced scFcA41BB CD2 zeta | 274 | Mcu1-Panko5e5-enhanced scFc B 41BB CD2 zeta | 275 | Mcu1-Panko5e5-enhanced scFc C 41BB CD2 zeta | 276 |
| Mcu1-Panko5e5-enhanced scFc D 41BB CD2 zeta | 277 | GS linker | 278 | Construct of TSHR CAR | 279 |

Example 5. In Vivo Cell Expansion

These clinical studies were designed to assess the safety and efficacy of infusing autologous T cells modified to express several solid tumor markers specific CAR/4-1BB/CD3-ζ into patients. On the first arm of the studies, patients received solid tumor marker-specific CAR T cells only. The solid tumor marker included TSHR and tMuc1. On the second arm, patients received CAR T cells directed to CD19 and tMuc1. T cells of the patients were obtained, modified, and infused to the patients. T cell responses of patients from the first and second arms were measured and compared using the following protocols, which were approved by the hospitals where the trials were conducted. All patients were provided with written informed consent.

Lentiviruses were produced by transfecting 293T cells with TSHR-4-1BB vectors. tMuc1-4-1BB vector, CARt-Muc1/CAR19-4-1BB vectors, and viral packaging plasmids, which were frozen in −80° C., were thawed immediately before transduction. The lentivirus supernatant was harvested. CD3+ T cells were isolated and activated as described (see Kalos M. et al, Sci Transl Med 2011; 3:95ra73). The CD3+ T cells were then cultured in X-VIVO 15 medium (Lonza) containing 100 U/ml interleukin-2 (IL-2) and transduced with the lentivirus supernatant at high multiplicity of infection (MOI) from 5:1 to 10:1 within 24-48 hours. The CAR transduced T cells (TSHR-CAR T cell, tMuc1-CAR T cell, or tMuc1-CAR/CD19-CAR T cell, hereafter "dual CAR T cells") were cultured for about 11 days. Three days before administration, fresh culture media were replaced. After that, the cells were not manipulated until transportation for infusion. The transduction efficiency was evaluated by flow cytometry (FACS) on days 5-7 after lentivirus transduction. The following anti-human antibodies were used: anti-hCD45 APC (BD Bioscience), anti-hCD3 FITC (BD Bioscience), biotin-labeled goat-anti-mouse IgG specific for F(ab')2 fragment (Jackson immuno-Research, Cat #115-065-072) and PE streptavidin (BD Bioscience). Data acquisition was performed using a Cyto-FLEX flow cytometer (Beckman).

Prior to CAR T cell infusion, FACS analysis of transduction efficiency and in vitro cytotoxicity assays of CAR T cells were performed for each patient as described in this Example and Examples 1 and 2. Additionally, CAR T cell cultures were checked twice for possible contaminations by fungus, bacteria, mycoplasma, chlamydia, and endotoxin.

Peripheral blood mononuclear cells (PBMCs) were obtained from patients by leukapheresis for CAR T cell preparation on day 8, and the first day of CAR T infusion was set as study day 0. Patients were given a conditioning treatment for lymphodepletion. Fludarabine- and cyclophosphamide-based conditioning treatment varied according to the tumor burden in the bone marrow (BM) and peripheral blood (PB). CAR T cells were transfused to patients. Each day CAR T cells were transported to hospital, washed, counted, checked for viability and then prepared for administration to patients, who were then observed closely for at least 2 hours. CRS was graded according to a revised grading system (See Lee D W. et al, Blood 2014; 124:188-95). Other toxicities during and after therapy were assessed according to the National Institutes of Health Common Terminology Criteria for Adverse Events Version 4.0 (http://ctep.cancer.gov/). Therapy responses were assessed by flow cytometry and morphological analysis. When possible, patients were assessed by chimeric gene expression levels. The response type was defined as minimal residual disease (MRD) negative, complete response, complete response with incomplete count recovery, stable disease, and progressive disease.

Serial BM and PB samples after CAR T cell infusion were collected in K2EDTA BD vacutainer tubes (BD). The persistence of CAR19 T cells from fresh PB and BM in patients was determined by FACS. Circulating CAR T cell numbers per µl were calculated on the basis of measured absolute CD3+ T lymphocyte counts. Simultaneously, CAR DNA copies were evaluated as another method of determining CAR T cell expansion and persistence. Genomic DNA was extracted using a QIAamp DNA Blood Mini Kit (Qiagen) from cryopreserved PB and BM. CAR DNA copies were assessed by quantitative real-time PCR as described in the supplementary materials. The levels of cytokines IFN-γ, TNF-α, IL-4, IL-6, IL-10, IL-17, etc. in serum and CSF were measured in a multiplex format according to the manufacturer's instructions.

Genomic DNA was extracted using a QIAamp DNA Blood Mini Kit (Qiagen) from cryopreserved peripheral blood and bone marrow. Quantitative PCR (qPCR) was performed in real-time in triplicates using the ABI 2× TaqMan Universal Master Mix with AmpErase UNG (Applied Biosystems) in a 7500 real-time PCR system (Applied Biosystems). Copy numbers per microgram of genomic DNA were calculated from a standard curve of 10-fold serial dilutions of purified CAR plasmid containing 102-108 copies/µL. Amplification of an internal control gene was used for normalization of DNA quantities. Primers/probes specific for the CAR19 transgene and an internal control gene were as previously described (see Gökbuget N. et al., Blood 2012; 120:2032-41 and O'Brien S. et al, J Clin Oncol 2013; 31:676-83).

CAR T cell expansion of these four patients are shown in FIGS. 16-20. These results demonstrate that T cells expressing CD19 CAR and tumor marker specific CAR expanded more than T cells expressing only the tumor maker specific CAR. Information regarding the patients and their corresponding T cells are provided below in Table 5.

TABLE 5

| Patient ID | Cancer type | solid tumor antigen | CAR binding solid tumor antigen SEQ ID | B cell antigen | CAR binding B cell Antigen SEQ ID | Vector SEQ ID | Infusion (date dosage) |
|---|---|---|---|---|---|---|---|
| A | Thyroid cancer | TSHR | 8 | N/A | N/A | 280 | 1st: $1.08*10^5$/kg |
| B | Cholangio-carcinoma | tMuc1 | 70 | N/A | N/A | 61 | 1st: $1.01*10^7$/kg |
| C | Pancreatic cancer | tMuc1 | 70 | N/A | N/A | 61 | 1st: $1.27*10^6$/kg<br>2nd: 71 Days after the 1st: ($1.29*10^7$/Kg) |
| D | Breast Cancer | tMuc1 | 70 | N/A | N/A | 61 | 1st Date: $1*10^5$/kg<br>2nd: 24 Days after the 1st: ($1.24*10^6$/Kg)<br>3rd: 37 days after the 2nd: $9.65*10^6$ |
| E | Breast cancer | tMuc1 | 70 | CD19 | 5 | 201 | 1st: $1.15*10^5$/kg |

All publications, patents and patent applications cited in this specification are incorporated herein by reference in their entireties as if each individual publication, patent or patent application were specifically and individually indicated to be incorporated by reference. While the foregoing has been described in terms of various embodiments, the skilled artisan will appreciate that various modifications, substitutions, omissions, and changes may be made without departing from the spirit thereof.

SEQUENCE LISTING (279 sequences)

SEQ ID NO: 1 - protein, 21 aa, Artificial Sequence
  Synthesized
MALPVTALLLPLALLLHAARP

SEQ ID NO: 2 - protein, 69 aa, Artificial Sequence
  Synthesized
AKPTTTPAPRPPTPAPTIASQPLSLRPEACRPAAGGAVHTRGLDFACDIYIWAPLAGTCGVLLLSLVIT

SEQ ID NO: 3 - protein, 42 aa, Artificial Sequence
  Synthesized
KRGRKKLLYIFKQPFMRPVQTTQEEDGCSCRFPEEEEGGCEL

SEQ ID NO: 4 - protein, 112 aa, Artificial Sequence
  Synthesized
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5 - protein, 242 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 6 - protein, 242 aa, Artificial Sequence
  Synthesized
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 7 - protein, 237 aa, Artificial Sequence
  Synthesized
DIQMTQSPASLSVSVGETVTITCRASENIYSNLAWYQQKQGKSPQLLVYVATNLADGVPSRFSGSGSGTQYSLKINSLQSEDFGSYYCQHFWGTPYTFGGGTKLGGGGSGGGGSGGGGSEVQLQQSGAELVKPGASVKLSCTASGFNINDTYMHWVKQRPEQGLEWIGRIDPANGNTKYDPKFQGKATITADTSSNTAYLQLSSLTSEDTAVYYCARGARGSRFAYWGQGTLVTVSA

SEQ ID NO: 8 - protein, 244 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 9 - protein, 252 aa, Artificial Sequence
  Synthesized
DIVLTQSPASLAVSLGQGATISCRASKSVSTSGYTYMHWYQQKPGQPPKLLIYLASNLESGVPARFSGSGSGTDFTLNIHPVEEEDAATYYCQHSGELPPSFGGGTKLEIKRAGGGGSGGGGSGGGGSEVQLVESGGDLVKPGGSLKLSCAVSGFTFSSYGMSWVRQTPDKRLEWVATVSSGGTYTYYPDSVKGRFTISRDNAKNTLYLQMSSLKSEDSAMYYCARHRGNYYATYYYAMDYWGQGTSVTVSS

SEQ ID NO: 10 - protein, 243 aa, Artificial Sequence
  Synthesized
DVQITQSPSYLAASPGETITINCRASKSISKYLAWYQEKPGKTNKLLIYSGSTLQSGIPSRFSGSGSGTDFTLTISSLEPEDFAMYYCQQHHEYPYTFGGGTKLEIKGGGGSGGGGSGGGGSQVQLQQPGAELVRPGASVKLSCKASGYTFTTYWMNWVKQRPEQGLEWIGRIDPYDSETHYNQKFKDKAILTVDKSSSTAYMQLSSLTSEDSAVYYCARGPYYGTNPWFPYWGQGTLVTVSS

SEQ ID NO: 11 - protein, 241 aa, Artificial Sequence
  Synthesized
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 12 - protein, 246 aa, Artificial Sequence
  Synthesized
DVVMTQTPLSLPVRLGDQASISCRSSQSLVHSNGNTYLHWYLQKPGQSPKLLIYKVSNRFSGVPDRFSGSGSGTNFTLKISRVEAEDLGLYFCSQSTHVPYTFGGGTKLEIKRAGGGGSGGGGSGGGGSQVQLRQSGPELVKPGASVKMSCKASGYTFTDYVISWVKQRTGQGLEWIGDIYPGSGYSFYNENFKGKATLTADKSSTTAYMQLSSLTSEDSAVYFCATYYNYPFAYWGQGTLVTVSA

SEQ ID NO: 13 - protein, 199 aa, Artificial Sequence
  Synthesized
LPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 14 - protein, 240 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIKGGGGGSGGGGSGGGGSDIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 15 - protein, 281 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIKGGGGGSGGGGSGGGGSMAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 16 - protein, 285 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELKGGGGGSGGGGSGGGGSMDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 17 - protein, 242 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIKGGGGGSGGGGSGGGGSQVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 18 - protein, 272 aa, Homo sapiens
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 19 - protein, 205 aa, Homo sapiens
ISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKR

SEQ ID NO: 20 - protein, 393 aa, Homo sapiens
GMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 21 - protein, 210 aa, Homo sapiens
QLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMND

SEQ ID NO: 22 - protein, 4368 aa, Homo sapiens
EQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYG

SEQ ID NO: 23 - protein, 407 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQ

SEQ ID NO: 24 - protein, 264 aa, Homo sapiens
PRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 25 - protein, 100 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENC

SEQ ID NO: 26 - protein, 371 aa, Homo sapiens
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 27 - protein, 348 aa, Homo sapiens
RLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNP

SEQ ID NO: 28 - DNA, 7902 bp, Artificial Sequence
  Synthesized
gtcgacactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgagtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacggctctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagaaatccactttggctcgagaagcttgatatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcc

SEQ ID NO: 29 - protein, 66 aa, Artificial Sequence
  Synthesized
TTTPAPRPPTPAPTIASQPLSLRPEACRPAAGGAVHTRGLDFACDIYIWAPLAGTCGVLLLSLVIT

SEQ ID NO: 30 - protein, 69 aa, Artificial Sequence
  Synthesized
TTTPAPRPPTPAPTIASQPLSLRPEACRPAAGGAVHTRGLDFACDIYIWAPLAGTCGVLLLSLVITLYC

SEQ ID NO: 31 - protein, 72 aa, Artificial Sequence
  Synthesized
AKPTTTPAPRPPTPAPTIASQPLSLRPEACRPAAGGAVHTRGLDFACDIYIWAPLAGTCGVLLLSLVITLYC

SEQ ID NO: 32 - protein, 69 aa, Artificial Sequence; identical to SEQ ID NO: 2
  Synthesized

SEQ ID NO: 33 - protein, 50 aa, Artificial Sequence
  Synthesized
AKPTTTPAPRPPTPAPTIASQPLSLRPEACRPAAGGAVHTRGLDFACDIY

SEQ ID NO: 34 - protein, 50 aa, Artificial Sequence; identical to SEQ ID NO: 33
  Synthesized

SEQ ID NO: 35 - protein, 47 aa, Artificial Sequence
  Synthesized
TTTPAPRPPTPAPTIASQPLSLRPEACRPAAGGAVHTRGLDFACDIY

SEQ ID NO: 36 - protein, 47 aa, Artificial Sequence; identical to SEQ ID NO: 35
  Synthesized

SEQ ID NO: 37 - protein, 22 aa, Artificial Sequence
  Synthesized
IWAPLAGTCGVLLLSLVITLYC

SEQ ID NO: 38 - protein, 22 aa, Artificial Sequence
  Synthesized
IWAPLAGTCGVLLLSLVITLYC

SEQ ID NO: 39 - protein, 270 aa, Artificial Sequence
  Synthesized
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGG

SEQ ID NO: 40 - protein, 19 aa, Artificial Sequence
  Synthesized
IWAPLAGTCGVLLLSLVIT

SEQ ID NO: 41 - DNA, 339 bp, Artificial Sequence
  Synthesized
agagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 42 - DNA, 1689 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 43 - DNA, 1689 bp, Homo sapiens
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 44 - DNA, 1689 bp, Artificial Sequence; identical to SEQ ID NO: 42
  Synthesized

SEQ ID NO: 45 - DNA, 1689 bp, Artificial Sequence; identical to SEQ ID NO: 43
  Synthesized

SEQ ID NO: 46 - protein, 106 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIK

SEQ ID NO: 47 - protein, 120 aa, Artificial Sequence
  Synthesized
QVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 48 - protein, 130 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELK

SEQ ID NO: 49 - protein, 139 aa, Artificial Sequence
  Synthesized
MDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 50 - protein, 112 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 51 - protein, 119 aa, Artificial Sequence
  Synthesized
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSS

SEQ ID NO: 52 - protein, 413 aa, Artificial Sequence
  Synthesized
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 53 - protein, 115 aa, Artificial Sequence
  Synthesized
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSS

SEQ ID NO: 54 - protein, 108 aa, Artificial Sequence
  Synthesized
EIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIK

SEQ ID NO: 55 - protein, 140 aa, Artificial Sequence
  Synthesized
MGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAA

SEQ ID NO: 56 - protein, 131 aa, Artificial Sequence
  Synthesized
MGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIR

SEQ ID NO: 57 - protein, 120 aa, Artificial Sequence
  Synthesized
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSS

SEQ ID NO: 58 - protein, 111 aa, Artificial Sequence
  Synthesized
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 59 - DNA, 1473 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 60 - DNA, 1446 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 61 - DNA, 1467 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 62 - DNA, 3533 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 63 - DNA, 3533 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 64 - DNA, 3545 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 65 - DNA, 3518 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 66 - DNA, 2994 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 67 - DNA, 2994 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 68 - DNA, 3009 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 69 - DNA, 2982 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 70 - protein, 244 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 71 - protein, 116 aa, Artificial Sequence
  Synthesized
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 72 - protein, 113 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 73 - protein, 12 aa, Artificial Sequence
  Synthesized
QSLLNSGDQKNY

SEQ ID NO: 74 - protein, 107 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 75 - protein, 9 aa, Artificial Sequence
  Synthesized
QNDYSYPLT

SEQ ID NO: 76 - protein, 8 aa, Artificial Sequence
  Synthesized
GYTFTDHA

SEQ ID NO: 77 - protein, 8 aa, Artificial Sequence
  Synthesized
FSPGNTDI

SEQ ID NO: 78 - protein, 9 aa, Artificial Sequence
  Synthesized
KTSTFFFDY

SEQ ID NO: 79 - protein, 246 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 80 - protein, 117 aa, Artificial Sequence
  Synthesized
EVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 81 - protein, 114 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRA

SEQ ID NO: 82 - protein, 16 aa, Artificial Sequence
  Synthesized
RSSKSLLHSNGITYFF

SEQ ID NO: 83 - protein, 7 aa, Artificial Sequence
  Synthesized
QMSNLAS

SEQ ID NO: 84 - protein, 9 aa, Artificial Sequence
  Synthesized
AQNLELPPT

SEQ ID NO: 85 - protein, 5 aa, Artificial Sequence
  Synthesized
NYWMN

SEQ ID NO: 86 - protein, 19 aa, Artificial Sequence
  Synthesized
EIRLKSNNYTTHYAESVKG

SEQ ID NO: 87 - protein, 6 aa, Artificial Sequence
  Synthesized
HYYFDY

SEQ ID NO: 88 - protein, 4 aa, Artificial Sequence
  Synthesized
GSTA

SEQ ID NO: 89 - protein, 97 aa, Artificial Sequence
  Synthesized
CSRAARGTIGARRTGQPLKEDPSAVPVFSVDAGELDFQWREKTPEPPVPCVPEQTEAATIVFPSGMGTSSPARRGSADGPRSAQPLRPEDGHCSWPL

SEQ ID NO: 90 - protein, 17 aa, Artificial Sequence
  Synthesized
CSRAARGTIDGHCSWPL

SEQ ID NO: 91 - protein, 21 aa, Artificial Sequence
  Synthesized
VGVVGGLLGSLVLLVWVLAVI

SEQ ID NO: 92 - protein, 18 aa, Artificial Sequence
  Synthesized
GNILNVSIKICLTLSPST

SEQ ID NO: 93 - protein, 9 aa, Artificial Sequence
  Synthesized
CSRAARGTI

SEQ ID NO: 94 - protein, 80 aa, Artificial Sequence
  Synthesized
GARRTGQPLKEDPSAVPVFSVDYGELDFQWREKTPEPPVPCVPEQTEYATIVFPSGMGTSSPARRGSADGPRSAQPLRPE

SEQ ID NO: 95 - protein, 80 aa, Artificial Sequence; identical to SEQ ID NO: 94
  Synthesized

SEQ ID NO: 96 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 97 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 98 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 99 - protein, 323 aa, Artificial Sequence [sequence omitted]

SEQ ID NO: 100 - protein, 127 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIK

SEQ ID NO: 101 - protein, 184 aa, Homo sapiens
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 102 - protein, 909 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 103 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 104 - protein, 418 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 105 - protein, 560 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMS

SEQ ID NO: 106 - protein, 14507 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 107 - protein, 267 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 108 - protein, 535 aa, Homo sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 109 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 110 - protein, 221 aa, Homo sapiens
MLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 111 - protein, 538 aa, Homo sapiens
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 112 - protein, 1017 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 113 - protein, 775 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 114 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 115 - protein, 537 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 116 - protein, 426 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 117 - protein, 328 aa, Homo sapiens
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 118 - protein, 620 aa, Homo sapiens
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 119 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 120 - protein, 431 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 121 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 122 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 123 - protein, 21 aa, Homo sapiens
MALPVTALLLPLALLLHAARP

SEQ ID NO: 124 - protein, 15 aa, Homo sapiens
GGGGSGGGGSGGGGS

SEQ ID NO: 125 - protein, 45 aa, Artificial Sequence
  Synthesized
TTTPAPRPPTPAPTIASQPLSLRPEACRPAAGGAVHTRGLDFACD

SEQ ID NO: 126 - protein, 23 aa, Artificial Sequence
  Synthesized
YIWAPLAGTCGVLLLSLVITLYC

SEQ ID NO: 127 - protein, 42 aa, Artificial Sequence; identical to SEQ ID NO: 3
  Synthesized

SEQ ID NO: 128 - protein, 112 aa, Artificial Sequence; identical to SEQ ID NO: 4
  Synthesized

SEQ ID NO: 129 - protein, 485 aa, Artificial Sequence
  Synthesized
MALPVTALLLPLALLLHAARPQIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 130 - protein, 241 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 131 - protein, 108 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIK

SEQ ID NO: 132 - protein, 118 aa, Artificial Sequence
  Synthesized
EVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 133 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 134 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 135 - protein, 106 aa, Artificial Sequence
  Synthesized
NVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKE

SEQ ID NO: 136 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 137 - protein, 485 aa, Artificial Sequence
  Synthesized
MALPVTALLLPLALLLHAARPDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVSTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 138 - protein, 241 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 139 - protein, 107 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIK

SEQ ID NO: 140 - protein, 119 aa, Artificial Sequence
  Synthesized
EVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 141 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 142 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 143 - protein, 106 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELK

SEQ ID NO: 144 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 145 - protein, 482 aa, Artificial Sequence
  Synthesized
MALPVTALLLPLALLLHAARPSSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 146 - protein, 238 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 147 - protein, 109 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLG

SEQ ID NO: 148 - protein, 114 aa, Artificial Sequence
  Synthesized
QLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 149 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 150 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 151 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 152 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 153 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 154 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 155 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 156 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 157 - protein, 112 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIK

SEQ ID NO: 158 - protein, 112 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIK

SEQ ID NO: 159 - protein, 123 aa, Artificial Sequence
  Synthesized
EIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 160 - protein, 123 aa, Artificial Sequence
  Synthesized
EIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 161 - protein, 123 aa, Artificial Sequence
  Synthesized
EIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 162 - protein, 123 aa, Artificial Sequence
  Synthesized
EIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 163 - protein, 482 aa, Artificial Sequence
  Synthesized
MALPVTALLLPLALLLHAARPDIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 164 - protein, 238 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 165 - protein, 107 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIK

SEQ ID NO: 166 - protein, 116 aa, Artificial Sequence
  Synthesized
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 167 - protein, 482 aa, Artificial Sequence
  Synthesized
MALPVTALLLPLALLLHAARPDIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 168 - protein, 238 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 169 - protein, 107 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIK

SEQ ID NO: 170 - protein, 116 aa, Artificial Sequence
  Synthesized
DVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 171 - protein, 298 aa, Artificial Sequence
  Synthesized
MALPVTALLLPLALLLHAARPGTSLSPPPESSGSPQQPGLSAPHSRQIPAPQGAVLVQREKDLPNYNWNSFGLRFTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 172 - protein, 54 aa, Artificial Sequence
  Synthesized
GTSLSPPPESSGSPQQPGLSAPHSRQIPAPQGAVLVQREKDLPNYNWNSFGLRF

SEQ ID NO: 173 - protein, 19 aa, Artificial Sequence
  Synthesized
GTTGCTCCAGGCCACAGCA

SEQ ID NO: 174 - protein, 7 aa, Artificial Sequence
  Synthesized
QSGDLTR

SEQ ID NO: 175 - protein, 7 aa, Artificial Sequence
  Synthesized
QWGTRYR

SEQ ID NO: 176 - protein, 7 aa, Artificial Sequence
  Synthesized
ERGTLAR

SEQ ID NO: 177 - protein, 7 aa, Artificial Sequence
  Synthesized
RSDNLRE

SEQ ID NO: 178 - protein, 7 aa, Artificial Sequence
  Synthesized
QSGDLTR

SEQ ID NO: 179 - protein, 7 aa, Artificial Sequence
  Synthesized
TSGALTR

SEQ ID NO: 180 - protein, 12 aa, Artificial Sequence
  Synthesized
GACTTTGCATGT

SEQ ID NO: 181 - protein, 7 aa, Artificial Sequence
  Synthesized
WRSSLAS

SEQ ID NO: 182 - protein, 7 aa, Artificial Sequence
  Synthesized
QSGSLTR

SEQ ID NO: 183 - protein, 7 aa, Artificial Sequence
  Synthesized
HKWVLRQ

SEQ ID NO: 184 - protein, 7 aa, Artificial Sequence
  Synthesized
DRSNLTR

SEQ ID NO: 185 - protein, 293 aa, Artificial Sequence
  Synthesized
MQRISSLIHLSLFWAGVMSAIELVPEHQTVPVSIGVPATLRCSMKGEAIGNYYINWYRKTQGNTITFIYREKDIYGPGFKDNFQGDIDIAKNLAVLKILAPSERDEGSYYCACDTMGHPRGKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLTRDC

SEQ ID NO: 186 - protein, 315 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEAQQELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 187 - protein, 292 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLGMGGEYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 188 - protein, 313 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEWELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 189 - protein, 288 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLVSTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 190 - protein, 314 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 191 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTVAHGGGTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 192 - protein, 313 aa, Artificial Sequence; identical to SEQ ID NO: 188
  Synthesized

SEQ ID NO: 193 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDNLSTGGYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 194 - protein, 316 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVYQGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 195 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDILGEKPYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 196 - DNA, 339 bp, Artificial Sequence; identical to SEQ ID NO: 41
  Synthesized

SEQ ID NO: 197 - protein, 276 aa, Artificial Sequence
  Synthesized
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSDRGSTLGRLYFGRGTQLTVWPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 198 - protein, 313 aa, Artificial Sequence
  Synthesized
MTIRLLCYVGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSGLRDRGLYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 199 - protein, 267 aa, Artificial Sequence
  Synthesized
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKDSNYQLIWGAGTKLIIKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 200 - protein, 138 aa, Artificial Sequence
  Synthesized
MAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 201 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 202 - protein, 488 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 203 - protein, 486 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 204 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 205 - protein, 485 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 207 - protein, 483 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 209 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 210 - protein, 490 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 212 - protein, 487 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 214 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 215 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 216 - protein, 486 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 218 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 219 - protein, 483 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 221 - protein, 3533 aa, Artificial Sequence
  Synthesized
ATGGCCTTACCAGTGACCGCCTTGCTCCTGCCGCTGGCCTTGCTGCTCCACGCCGCCAGGCCGGACATCGTGATGACCCAGTCCCCCTCCAGCCTGACAGTGACAGCCGGCGAGAAGGTGACAATGATCTGTAAGTCCAGCCAGAGCCTGCTGAACAGCGGCGACCAGAAGAACTACCTGACCTGGTACCAGCAGAAGCCTGGCCAGCCCCCCAAGCTGCTGATCTTCTGGGCCAGCACAAGGGAGAGCGGCGTGCCCGACAGATTCACAGGCAGCGGCAGCGGCACCGACTTCACACTGACCATTTCCTCCGTGCAGGCCGAGGACCTCGCCGTGTACTACTGCCAGAACGACTACTCCTACCCCCTGACATTCGGCGCCGGCACCAAACTGGAGCTGAAGGGTGGCGGTGGCTCGGGCGGTGGTGGGTCGGGTGGCGGCGGATCTCAGGTGCAGCTCCAGCAGTCCGATGCCGAGCTGGTGAAGCCCGGAAGCAGCGTCAAGATCAGCTGTAAGGCCTCCGGCTACACCTTCACAGACCACGCCATCCACTGGGTGAAGCAGAAGCCCGAGCAGGGCCTGGAGTGGATCGGCCACTTTAGCCCCGGAAACACCGACATCAAGTACAACGACAAGTTCAAGGGCAAGGCCACCCTGACCGTGGACAGGAGCAGCAGCACCGCCTACATGCAGCTGAACAGCCTGACAAGCGAGGACAGCGCCGTGTACTTCTGCAAGACCTCCACCTTCTTCTTCGACTACTGGGGCCAGGGAACCACCCTGACAGTGTCCAGCACCACGACGCCAGCGCCGCGACCACCAACACCGGCGCCCACCATCGCGTCGCAGCCCCTGTCCCTGCGCCCAGAGGCGTGCCGGCCAGCGGCGGGGGGCGCAGTGCACACGAGGGGGCTGGACTTCGCCTGTGATATCTACATCTGGGCGCCCTTGGCCGGGACTTGTGGGGTCCTTCTCCTGTCACTGGTTATCACCCTTTACTGCAAACGGGGCAGAAAGAAACTCCTGTATATATTCAAACAACCATTTATGAGACCAGTACAAACTACTCAAGAGGAAGATGGCTGTAGCTGCCGATTTCCAGAAGAAGAAGAAGGAGGATGTGAACTGAGAGTGAAGTTCAGCAGGAGCGCAGACGCCCCCGCGTACAAGCAGGGCCAGAACCAGCTCTATAACGAGCTCAATCTAGGACGAAGAGAGGAGTACGATGTTTTGGACAAGAGGCGTGGCCGGGACCCTGAGATGGGGGGAAAGCCGAGAAGGAAGAACCCTCAGGAAGGCCTGTACAATGAACTGCAGAAAGATAAGATGGCGGAGGCCTACAGTGAGATTGGGATGAAAGGCGAGCGCCGGAGGGGCAAGGGGCACGATGGCCTTTACCAGGGTCTCAGTACAGCCACCAAGGACACCTACGACGCCCTTCACATGCAGGCCCTGCCCCCTCGCTAATCTAGAGGCGCGCCCCTCTCCCTCCCCCCCCCCTAACGTTACTGGCCGAAGCCGCTTGGAATAAGGCCGGTGTGCGTTTGTCTATATGTTATTTTCCACCATATTGCCGTCTTTTGGCAATGTGAGGGCCCGGAAACCTGGCCCTGTCTTCTTGACGAGCATTCCTAGGGGTCTTTCCCCTCTCGCCAAAGGAATGCAAGGTCTGTTGAATGTCGTGAAGGAAGCAGTTCCTCTGGAAGCTTCTTGAAGACAAACAACGTCTGTAGCGACCCTTTGCAGGCAGCGGAACCCCCCACCTGGCGACAGGTGCCTCTGCGGCCAAAAGCCACGTGTATAAGATACACCTGCAAAGGCGGCACAACCCCAGTGCCACGTTGTGAGTTGGATAGTTGTGGAAAGAGTCAAATGGCTCTCCTCAAGCGTATTCAACAAGGGGCTGAAGGATGCCCAGAAGGTACCCCATTGTATGGGATCTGATCTGGGGCCTCGGTACACATGCTTTACATGTGTTTAGTCGAGGTTAAAAAAACGTCTAGGCCCCCCGAACCACGGGGACGTGGTTTTCCTTTGAAAAACACGATGATAATATGGCCACAACCCATATGATGGCCTTACCAGTGACCGCCTTGCTCCTGCCGCTGGCCTTGCTGCTCCACGCCGCCAGGCCGGATATCCAGATGACCCAGAGCCCGAGCAGCCTGAGCGCGAGCGTGGGTGATCGCGTGACCATTACCTGCAGGGCAAGTCAGGACATTAGTAAATATTTAAATTGGTATCAGCAGAAACCGGGTAAAGCGCCGAAACTGTTAATTTATCATACATCAAGATTACACTCAGGCGTGCCGTCGCGTTTTAGCGGCTCGGGTTCGGGCACCGATTTTACCCTGACCATCTCGAGCTTGCAGCCGGAGGACTTCGCCACCTACTATTGCCAACAGGGTAATACGCTTCCGTACACGTTCGGTCAGGGCACCAAAGTGGAGATCAAAGGTGGCGGTGGCTCGGGCGGTGGTGGGTCGGGTGGCGGCGGATCTGAGGTGCAGCTGGTGGAGTCTGGGGGAGGCTTGGTACAGCCTGGGGGGTCCCTGAGACTCTCCTGTGCAGCCTCTGGAGTGTCCCTGCCTGATTATGGCGTGTCCTGGGTCCGCCAGGCTCCAGGGAAGGGGCTGGAGTGGGTTTCAGTGATCTGGGGCAGCGAGACAACCTACTACAACAGCGCCCTGAAGTCCCGATTCACCATCTCCAGAGACAATGCCAAGAACTCACTGTATCTGCAAATGAACAGCCTGAGAGCCGAGGACACGGCTGTGTATTACTGTGCGAAGCACTACTACTACGGCGGCAGCTACGCTATGGACTACTGGGGCCAAGGAACCCTGGTCACCGTGTCCTCAACCACGACGCCAGCGCCGCGACCACCAACACCGGCGCCCACCATCGCGTCGCAGCCCCTGTCCCTGCGCCCAGAGGCGTGCCGGCCAGCGGCGGGGGGCGCAGTGCACACGAGGGGGCTGGACTTCGCCTGTGATATCTACATCTGGGCGCCCTTGGCCGGGACTTGTGGGGTCCTTCTCCTGTCACTGGTTATCACCCTTTACTGCAAACGGGGCAGAAAGAAACTCCTGTATATATTCAAACAACCATTTATGAGACCAGTACAAACTACTCAAGAGGAAGATGGCTGTAGCTGCCGATTTCCAGAAGAAGAAGAAGGAGGATGTGAACTGAGAGTGAAGTTCAGCAGGAGCGCAGACGCCCCCGCGTACAAGCAGGGCCAGAACCAGCTCTATAACGAGCTCAATCTAGGACGAAGAGAGGAGTACGATGTTTTGGACAAGAGGCGTGGCCGGGACCCTGAGATGGGGGGAAAGCCGAGAAGGAAGAACCCTCAGGAAGGCCTGTACAATGAACTGCAGAAAGATAAGATGGCGGAGGCCTACAGTGAGATTGGGATGAAAGGCGAGCGCCGGAGGGGCAAGGGGCACGATGGCCTTTACCAGGGTCTCAGTACAGCCACCAAGGACACCTACGACGCCCTTCACATGCAGGCCCTGCCCCCTCGCTAA

SEQ ID NO: 222 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 223 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 224 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 225 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 226 - protein, 490 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 227 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 228 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 229 - protein, 487 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 231 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 232 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 233 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 234 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 235 - DNA, 3665 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 236 - protein, 530 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 238 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 239 - protein, 527 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 240 - DNA, 3665 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 241 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 242 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 243 - DNA, 3647 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 244 - DNA, 3518 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 245 - protein, 482 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 246 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 247 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 248 - protein, 479 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 249 - DNA, 3500 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 250 - DNA, 3518 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 251 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 252 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 253 - DNA, 3500 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 254 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 255 - protein, 490 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 256 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 257 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 258 - protein, 487 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 259 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 260 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 261 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 262 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 263 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 264 - protein, 505 aa, Artificial Sequence
  Synthezied
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 265 - protein, 505 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 266 - protein, 69 aa, Artificial Sequence; identical to SEQ ID NO: 30
  Synthesized

SEQ ID NO: 267 - protein, 66 aa, Artificial Sequence; identical to SEQ ID NO: 29
  Synthesized

SEQ ID NO: 268 - protein, 69 aa, Artificial Sequence; identical to SEQ ID NO: 2
  Synthesized

SEQ ID NO: 269 - protein, 72 aa, Artificial Sequence; identical to SEQ ID NO: 31
  Synthezied

SEQ ID NO: 270 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - protein, 725 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 272 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 273 - protein, 731 aa, Artificial Sequence
  Synthezied
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 274 - protein, 728 aa, Artificial Sequence
  Synthezied
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 275 - protein, 725 aa, Artificial Sequence
  Synthezied
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 276 - protein, 728 aa, Artificial Sequence
  Synthezied
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 277 - protein, 731 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 278 - protein, 5 aa, Artificial Sequence
  Synthesized
GGGGS

SEQ ID NO: 279 - DNA, 1470 bp, Artificial Sequence
  Synthesized
atggccttaccagtgaccgccttgctcctgccgctggccttgctgctccacgccgccaggccgcagtccgtgctgacccagccaccttccgtgtctgccgctccaggccagaaggtgacaatcagctgctccggcagctcctctgacatcggaagcaactacgtgtcctggtaccagcagttcccaggcaccgcccccaagctgctgatctacgacaacaacaagaggcctagcgccatcccagatagattttctggcagcaagtccggaacctccgccacactgggcatcaccggactgcagacaggcgacgaggctgattactactgcggcacatgggattccaggctgggaatcgccgtgttcggaggaggaacccagctgacagtgctgggcggaggaggaggaagcggaggaggaggatccggaggaggaggatctgaggtgcagctggtgcagtctggcgccgaggtgaagaagcctggacagtctctgaagatcagctgtaaggcttccggctactctctgaccgacaactggatcggatgggtgcggcagaagccaggcaagggactggagtggatgggcatcatctacccaggagactctgatacacgctactctcccagctttcagggccaggtgaccatctccgccgataagtctatcaacacagcttacctgcagtggagctccctgaaggccagcgacaccgctatctactactgcgtgggcctggattggaactacaacccactgaggtactggggacctggaaccctggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

The invention claimed is:

1. A method for enhancing T cell expansion in a subject having cancer, the method comprising:
    obtaining modified T cells comprising a chimeric antigen receptor (CAR) binding tMUC comprising an amino acid sequence of SEQ ID NO: 70 and a CAR binding CD19 comprising an amino acid sequence of SEQ ID NO: 5 or 6, wherein the CAR comprises an antigen binding domain, a transmembrane domain, and a cytoplasmic domain and wherein the modified T cells comprise autologous T cells derived from the subject; and
    administering an effective amount of the modified T cells to the subject, wherein the modified T cells enhance the expansion of the modified T cells in the subject as compared to the subject administered with modified T cells comprising the CAR binding CD19 in the absence of CAR binding tMUC or administered with modified T cells comprising the CAR binding tMUC in the absence of CAR binding CD19.

2. The method of claim 1, wherein the cytoplasmic domain comprises a co-stimulatory domain, CD3 zeta domain, or a combination thereof.

3. The method of claim 1, wherein the T cell expansion is greater than a T cell expansion obtained by administering modified T cells comprising the CAR binding tMUC in the absence of the CAR binding CD19.

4. The method of claim 3, wherein the T cell expansion is measured based on an increase in copy number of CAR molecules in genomic DNA of the modified T cells in peripheral blood of the subject having cancer.

5. The method of claim 1, wherein the CAR binding CD19 comprises an amino acid sequence of SEQ ID NO: 203, 207, 216, or 219.

6. The method of claim 1, wherein the CAR binding tMUC comprises an amino acid sequence of SEQ ID NO: 202 or 205.

7. The method of claim 1, wherein the modified T cells comprise a nucleic acid sequence of SEQ ID NO: 201, 204, 206, 208, 215, 217, 218, or 220.

8. The method of claim 1, wherein the enhancing T cell expansion in the subject having cancer comprises enhancing expansion of the modified T cells in peripheral blood of the subject having cancer.

9. The method of claim 1, wherein the cancer is breast cancer.

* * * * *